(12) United States Patent
Nestor

(10) Patent No.: US 11,541,028 B2
(45) Date of Patent: Jan. 3, 2023

(54) PEPTIDE PHARMACEUTICALS FOR TREATMENT OF NASH AND OTHER DISORDERS

(71) Applicant: Mederis Diabetes LLC, Sugar Land, TX (US)

(72) Inventor: John J Nestor, Sugar Land, TX (US)

(73) Assignee: Altimmune Inc., Gaithersburg, MD (US)

( * ) Notice: Subject to any disclaimer, the term of this patent is extended or adjusted under 35 U.S.C. 154(b) by 199 days.

(21) Appl. No.: 16/958,597

(22) PCT Filed: Jan. 3, 2019

(86) PCT No.: PCT/US2019/012194
§ 371 (c)(1),
(2) Date: Jun. 26, 2020

(87) PCT Pub. No.: WO2019/136158
PCT Pub. Date: Jul. 11, 2019

(65) Prior Publication Data
US 2020/0352900 A1 Nov. 12, 2020

Related U.S. Application Data

(60) Provisional application No. 62/613,396, filed on Jan. 3, 2018.

(51) Int. Cl.
| A61K 31/351 | (2006.01) |
| A61P 1/16 | (2006.01) |
| A61P 13/12 | (2006.01) |
| A61K 38/26 | (2006.01) |
| A61K 47/54 | (2017.01) |
| A61K 9/00 | (2006.01) |
| A61K 45/06 | (2006.01) |

(52) U.S. Cl.
CPC ............ *A61K 31/351* (2013.01); *A61K 38/26* (2013.01); *A61P 1/16* (2018.01); *A61P 13/12* (2018.01); *A61K 9/0019* (2013.01); *A61K 45/06* (2013.01); *A61K 47/543* (2017.08); *A61K 47/549* (2017.08)

(58) Field of Classification Search
None
See application file for complete search history.

(56) References Cited

U.S. PATENT DOCUMENTS

| 3,219,656 A | 11/1965 | Boettner |
| 3,839,318 A | 10/1974 | Mansfield |
| 4,179,337 A | 12/1979 | Davis et al. |
| 4,301,144 A | 11/1981 | Iwashita et al. |
| 4,496,689 A | 1/1985 | Mitra |
| 4,640,835 A | 2/1987 | Shimizu et al. |
| 4,670,417 A | 6/1987 | Iwasaki et al. |
| 4,675,189 A | 6/1987 | Kent et al. |
| 4,791,192 A | 12/1988 | Nakagawa et al. |
| 5,574,142 A | 11/1996 | Meyer, Jr. et al. |
| 6,309,633 B1 | 10/2001 | Ekwuribe et al. |
| 6,720,407 B1 | 4/2004 | Hughes et al. |
| 6,815,530 B2 | 11/2004 | Ekwuribe et al. |
| 6,835,802 B2 | 12/2004 | Ekwuribe et al. |
| 6,864,069 B2 | 3/2005 | Pan et al. |
| 7,390,788 B2 | 6/2008 | Pert et al. |
| 7,425,542 B2 | 9/2008 | Maggio |
| 9,150,652 B2 | 10/2015 | Theuer et al. |
| 9,178,201 B2 | 11/2015 | Lee et al. |
| 9,856,306 B2 | 1/2018 | Nestor |
| 10,005,817 B2 | 6/2018 | Nestor |
| 10,010,617 B2 | 7/2018 | Nestor et al. |
| 2003/0202981 A1 | 10/2003 | Kream |
| 2004/0137557 A1 | 7/2004 | Defrees et al. |
| 2006/0045868 A1 | 3/2006 | Meezan et al. |
| 2006/0045869 A1 | 3/2006 | Meezan et al. |
| 2007/0111938 A1 | 5/2007 | Pert et al. |
| 2008/0200390 A1 | 8/2008 | Prickett et al. |
| 2008/0227722 A1 | 9/2008 | Wang |
| 2008/0268032 A1 | 10/2008 | Maggio |
| 2008/0299079 A1 | 12/2008 | Maggio et al. |
| 2010/0048462 A1 | 2/2010 | Ryge et al. |
| 2010/0190701 A1 | 7/2010 | Day et al. |
| 2011/0257096 A1 | 10/2011 | Maggio |
| 2014/0314742 A1 | 10/2014 | Theuer et al. |
| 2014/0349928 A1 | 11/2014 | Nestor et al. |
| 2015/0031630 A1 | 1/2015 | Nestor et al. |
| 2015/0290334 A1 | 10/2015 | Nestor |

(Continued)

FOREIGN PATENT DOCUMENTS

| AT | 382381 I | 1/2008 |
| CN | 1635901 A | 7/2005 |

(Continued)

OTHER PUBLICATIONS

Defaye, J et al., "Hydrogen Fluoride, Solvent and Reagent for Carbohydrate Conversion Technology", Carbohydrates as Organic Raw Materials, VCH Publishers, (19910000), pp. 247-265.
"Chain A, Dihydroorotate Dehydrogenase a From Lactococcus Lactis", Genbank, (Oct. 10, 2012), Database accession No. 1DOR_A, URL: NCBI, XP055256755.
Aaboe, K., et al., GLP-1: physiological effects and potential therapeutic applications, Diabetes Obes Metab, Nov. 2008;10(11):994-1003.

(Continued)

*Primary Examiner* — Paul V Ward
(74) *Attorney, Agent, or Firm* — Koren Anderson; Duane Morris LLP

(57) ABSTRACT

The disclosure provides peptide products comprising a peptide covalently attached to a surfactant moiety which have improved properties, including increased duration of action and bioavailability. The peptide products are useful for treating insulin resistance, diabetes, obesity, metabolic syndrome and cardiovascular diseases, and conditions associated therewith, such as NASH and PCOS.

6 Claims, 65 Drawing Sheets
Specification includes a Sequence Listing.

(56) References Cited

U.S. PATENT DOCUMENTS

| | | | |
|---|---|---|---|
| 2015/0307550 | A1 | 10/2015 | Nestor et al. |
| 2017/0096468 | A1 | 4/2017 | Nestor et al. |

FOREIGN PATENT DOCUMENTS

| | | | |
|---|---|---|---|
| CN | 103732617 | A | 4/2014 |
| EP | 1767545 | A1 | 3/2007 |
| EP | 3155017 | A1 | 4/2017 |
| JP | H1160598 | A | 3/1999 |
| JP | 2003502364 | A | 1/2003 |
| JP | 2011524419 | A | 9/2011 |
| JP | 2012531431 | A | 12/2012 |
| JP | 2014511554 | A | 5/2014 |
| KR | 1020020012278 | A | 2/2002 |
| RU | 2181729 | C1 | 4/2002 |
| WO | 9119481 | A1 | 12/1991 |
| WO | 9500151 | A1 | 1/1995 |
| WO | 0078302 | A1 | 12/2000 |
| WO | 02098446 | A1 | 12/2002 |
| WO | 2004093902 | A1 | 11/2004 |
| WO | 2006064530 | A2 | 6/2006 |
| WO | 2006121860 | A2 | 11/2006 |
| WO | 2007060692 | A2 | 5/2007 |
| WO | 2008052043 | A2 | 5/2008 |
| WO | 2009155258 | A2 | 12/2009 |
| WO | 2010151703 | A1 | 12/2010 |
| WO | 2012158962 | A2 | 11/2012 |
| WO | 2012158965 | A2 | 11/2012 |
| WO | 2014081864 | A1 | 5/2014 |
| WO | 2014081872 | A1 | 5/2014 |
| WO | 2015184177 | A1 | 12/2015 |

OTHER PUBLICATIONS

Abbenante, G., et al., Protease inhibitors in the clinic, Med Chem, Jan. 2005;1(1):71-104.
Adelhorst, K., et al., Structure-activity studies of glucagon-like peptide-1, J Biol Chem, Mar. 4, 1994;269(9):6275-6278.
Ahsan, F., et al., Enhanced bioavailability of calcitonin formulated with alkylglycosides following nasal and ocular administration in rats, Pharm Res, Dec. 2001;18(12):1742-1746.
Akiyama.K., et al., "Characterization of [3H][2-D-penicillamine, 5-D-penidllamine]-enkephalin binding to delta opiate receptors in the rat brain and neuroblastoma—glioma hybrid cell line (NG 108-15)", PNAS USA, Apr. 1985;82(8):2543-7.
Andya, J.D. et al., Pharm Res, (19990000), vol. 16, pp. 350-358.
Arakawa, T., et al., Stabilization of protein structure by sugars, Biochemistry, Dec. 7, 1982;21(25):6536-6544.
Arakawa, T., et al., The stabilization of proteins by osmolytes, Biophys J, Mar. 1985;47(3):411-414.
Arnold, J.J., et al.. Correlation of tetradecylmaltoside induced increases in nasal peptide drug delivery with morphological changes in nasal epithelial cells, J Pharm Sci, Sep. 2004;93(9):2205-2213.
Australian Patent Application No. 2012255116 Patent Examination Report No. 1 dated Jun. 14, 2016.
Avidor-Reiss,T., et al., kappa-Opioid receptor-transfected cell lines: modulation of adenylyl cyclase activity following acute and chronic opioid treatments, FEBS Lett, Mar. 13, 1995;361(1):70-74.
Bachem compound H-8865. 1 page. Downloaded Aug. 23, 2017 from: http://shop.bachem.com/h-8865.html.
Barazza, A., et al., "Bioactive N-terminal undecapeptides derived from parathyroid hormone: the role of alpha-helicity", J Pept Res, Jan. 2005;65(1):23-35.
Bergwitz, C., et al., "Full activation of chimeric receptors by hybrids between parathyroid hormone and calcitonin. Evidence for a common pattern of ligand-receptor interaction", J Biol Chem, Oct. 25, 1996;271(43):26469-26472.
Binder, T.P., et al., Inhibition of *Streptococcus mutans* 6715 glucosyltransferases by sucrose analogs modified at positions 6 and 6', Carbohydr Res, 1985;140(1):9-20.

Biondi, L., et al., "Novel glycosylated [Lys(7)]-dermorphin analogues: synthesis, biological activity and conformational investigations", J Pept Sci, 2007;13(3):179-189.
Bloom, S.R. et al., Mol Interv, (20080000), vol. 8, pp. 82-98.
Boyce, B.F., et al., "Biology of RANK, RANKL, and osteoprotegerin", Arthritis Res Ther, 2007;9(Suppl 1):S1.
Brixen, K.T., et al., Teriparatide (biosynthetic human parathyroid hormone 1-34): a new paradigm in the treatment of osteoporosis, Basic Clin Pharmacol Toxicol, Jun. 2004;94(6):260-270.
Bryant, S., et al. Dmt and opioid peptides: a potent alliance. Biopolymers. 2003;71(2):86-102.
Buse, J.B., et al., Duration-1: exenatide once weekly produces sustained glycemic control and weight loss over 52 weeks, Diabetes Care, 2010;33:1255-1261.
Caliceti, P., et al., Pharmacokinetic and biodistribution properties of poly(ethylene glycol)-protein conjugates, Adv Drug Deliv Rev, 2003;55(10):1261-1277.
Carbohydrates as Organic Raw Materials, VCH Publishers, (19910000).
CAS 69227-93-6. n-Dodecyl-β-D-maltoside. Santa Cruz Biotech, 2007.
Casadevall, N., et al., "Pure red-cell aplasia and antierythropoietin antibodies in patients treated with recombinant erythropoietin", N Engl J Med, Feb. 14, 2002;346(7):469-475.
Chakraborty, T.K., et al., "Sugar amino acids in designing new molecules", Glycoconj J, Mar. 2005;22(3):83-93.
Chan, E.K., et al., Suppression of weight gain by glucagon in obese Zucker rats, Exp Mol Pathol, Jun. 1984;40 (3):320-327.
Chawla, A.S., et al., Aggregation of insulin, containing surfactants, in contact with different materials, Diabetes, May 1985;34(5):420-424.
Chem. Abstr., (19880000), vol. 108, p. 114719.
Chem. Abstr., (19890000), vol. 110, p. 137536.
Cheng, Z., et al., "Prolonged treatments with antiresorptive agents and PTH have different effects on bone strength and the degree of mineralization in old estrogen-deficient osteoporotic rats", J Bone Miner Res, Feb. 2009;24(2):209-220.
Chicchi, G.G., et al., Alterations in receptor activation and divalent cation activation of agonist binding by deletion of intracellular domains of the glucagon receptor, J Biol Chem, Mar. 21, 1997;272(12):7765-7769.
China Patent Application No. 201580041790.0; First Office Action (in Chinese) and translation (English) dated Jun. 28, 2019.
Chinese Patent Application No. 201280035528.1 Second Office Action dated Sep. 9, 2015 (English translation).
Chinese Patent Application No. 201280035629.9 Third Office Action dated Aug. 16, 2016.
Clodfelter,D.K., et al., "Effects of non-covalent self-association on the subcutaneous absorption of a therapeutic peptide", Pharm Res, Feb. 1998;15(2):254-262.
Codee, J.D., et al., A modular strategy toward the synthesis of heparin-like oligosaccharides using monomeric building blocks in a sequential glycosylation strategy, J Am Chem Soc, Mar. 23, 2005;127(11):3767-3773.
Cohen, M.A., et al., Oxyntomodulin suppresses appetite and reduces food intake in humans, J Clin Endocrinol Metab, Oct. 2003;88(10):4696-4701.
Condon, S.M., et al., "Analogues of human parathyroid hormone (1-31)NH(2): further evaluation of the effect of conformational constraint on biological activity", Bioorg Med Chem, Mar. 2002,10(3):731-736.
Constantino L., et al., Peptide-derivatized biodegradable nanoparticles able to cross the blood-brain barrier. Journal of Controlled Release, Nov. 2, 2005;108(1):84-96.
Cudic, M., et al., Preparation of glycosylated amino adds suitable for Fmoc solid-phase assembly, Methods Mol Biol, 2008;494:187-208.
Dakin, C.L., et al., Peripheral oxyntomodulin reduces food intake and body weight gain in rats, Endocrinology, Jun. 2004;145(6):2687-2695.
Database—UniProtKB, accession No. P68955 (GLUC_TRASC), last sequence update: Jul. 21, 1986.

(56) References Cited

OTHER PUBLICATIONS

Davidson, M.H., et al., Cardiovascular effects of glucagonlike peptide-1 agonists, Am J Cardiol, Aug. 2, 2011;108(3 Suppl):33B-41B.

Day, J.W., et al., A new glucagon and GLP-1 co-agonist eliminates obesity in rodents, Nat Chem Biol, Oct. 2009;5 (10):749-757.

De Graaf, A.J., et al., Nonnatural amino acids for site-specific protein conjugation, Bioconjug Chem, Jul. 2009;20 (7):1281-1295.

De Mico, A., et al., A Versatile and Highly Selective Hypervalent Iodine (III)/2,2,6,6-Tetramethyl-1-piperidinyloxyl-Mediated Oxidation of Alcohols to Carbonyl Compounds, J Org Chem, 1997;62(20):6974-6977.

Deacon, et al., "Dipeptidyi peptidase IV resistant analogues of glucagon-like peptide-1 which have extended metabolic stability and improved biological activity", Diabetologia, 1998;41(3):271-278.

FIG. 1
Table 1

| | SEQ. ID. NO. | 1 | | | | 5 | | | | | 10 | | | | | 15 | | | | | 20 |
|---|---|---|---|---|---|---|---|---|---|---|---|---|---|---|---|---|---|---|---|---|---|
| EU-A300 | 4 | H | Aib | Q | G | T | F | T | S | D | L | Lys(C8)-# | | | | | | | | | |
| EU-A301 | 5 | H | Aib | Q | G | T | F | T | S | D | L | Lys(C12)-# | | | | | | | | | |
| EU-A302 | 6 | H | Aib | Q | G | T | F | T | S | D | L | Lys(C16)-# | | | | | | | | | |
| EU-A303 | 7 | H | Aib | Q | G | T | F | T | S | D | Bip | Lys(C8)-# | | | | | | | | | |
| EU-A304 | 8 | H | Aib | Q | G | T | F | T | S | D | Bip | Lys(C12)-# | | | | | | | | | |
| EU-A305 | 9 | H | Aib | Q | G | T | F | T | S | D | Bip | Lys(C16)-# | | | | | | | | | |
| EU-A306 | 10 | H | Aib | Q | G | T | F | T | S | D | Nal(2) | Lys(C8)-# | | | | | | | | | |
| EU-A307 | 11 | H | Aib | Q | G | T | F | T | S | D | Nal(2) | Lys(C12)-# | | | | | | | | | |
| EU-A308 | 12 | H | Aib | Q | G | T | F | T | S | D | Nal(2) | Lys(C16)-# | | | | | | | | | |
| EU-A309 | 13 | H | Aib | Q | G | T | 2,6FF | T | S | D | Bip2Et4MeO | Lys(C8)-# | | | | | | | | | |
| EU-A310 | 14 | H | Aib | Q | G | T | 2,6FF | T | S | D | Bip2Et4MeO | Lys(C12)-# | | | | | | | | | |
| EU-A311 | 15 | H | Aib | Q | G | T | 2,6FF | T | S | D | Bip2Et4MeO | Lys(C16)-# | | | | | | | | | |
| EU-A312 | 16 | H | Aib | Q | G | T | F | T | S | D | L | S | K | Y | L | Lys(C8)-# | | | | | |
| EU-A313 | 17 | H | Aib | Q | G | T | F | T | S | D | L | S | K | Y | L | Lys(C12)-# | | | | | |
| EU-A314 | 18 | H | Aib | Q | G | T | F | T | S | D | L | S | K | Y | L | Lys(C16)-# | | | | | |
| EU-A315 | 19 | H | Aib | Q | G | T | F | T | S | D | Bip | S | K | Y | L | Lys(C8)-# | | | | | |
| EU-A316 | 20 | H | Aib | Q | G | T | F | T | S | D | Bip | S | K | Y | L | Lys(C12)-# | | | | | |
| EU-A317 | 21 | H | Aib | Q | G | T | F | T | S | D | Bip | S | K | Y | L | Lys(C16)-# | | | | | |
| EU-A318 | 22 | H | Aib | Q | G | T | F | T | S | D | Nal(2) | S | K | Y | L | Lys(C8)-# | | | | | |
| EU-A319 | 23 | H | Aib | Q | G | T | F | T | S | D | Nal(2) | S | K | Y | L | Lys(C12)-# | | | | | |
| EU-A320 | 24 | H | Aib | Q | G | T | F | T | S | D | Nal(2) | S | K | Y | L | Lys(C16)-# | | | | | |
| EU-A321 | 25 | H | Aib | Q | G | T | 2,6FF | T | S | D | Bip2Et4MeO | S | K | Y | L | Lys(C8)-# | | | | | |
| EU-A322 | 26 | H | Aib | Q | G | T | 2,6FF | T | S | D | Bip2Et4MeO | S | K | Y | L | Lys(C12)-# | | | | | |
| EU-A323 | 27 | H | Aib | Q | G | T | 2,6FF | T | S | D | Bip2Et4MeO | S | K | Y | L | Lys(C16)-# | | | | | |
| EU-A324 | 28 | H | Aib | Q | G | T | F | T | S | D | V | S | K | Y | L | D | G | R | Lys(C8)-# | | |
| EU-A325 | 29 | H | Aib | Q | G | T | F | T | S | D | L | S | K | Y | L | D | G | R | Lys(C8)-# | | |
| EU-A326 | 30 | H | Aib | Q | G | T | F | T | S | D | L | S | K | Y | L | D | G | R | Lys(C12)-# | | |
| EU-A327 | 31 | H | Aib | Q | G | T | F | T | S | D | L | S | K | Y | L | D | G | R | Lys(C16)-# | | |
| EU-A328 | 32 | H | Aib | Q | G | T | F | T | S | D | Bip | S | K | Y | L | D | G | R | Lys(C8)-# | | |
| EU-A329 | 33 | H | Aib | Q | G | T | F | T | S | D | Bip | S | K | Y | L | D | G | R | Lys(C12)-# | | |
| EU-A330 | 34 | H | Aib | Q | G | T | F | T | S | D | Bip | S | K | Y | L | D | G | R | Lys(C16)-# | | |

FIG. 1 (Continued)
Table 1 (Continued)

| | SEQ. ID. NO. | 1 | | | | 5 | | | | | 10 | | | | | 15 | | | | | 20 |
|---|---|---|---|---|---|---|---|---|---|---|---|---|---|---|---|---|---|---|---|---|---|
| EU-A331 | 35 | H | Aib | Q | G | T | F | T | S | D | Nal(2) | S | K | Y | L | D | G | R | Lys(C8)-# | | |
| EU-A332 | 36 | H | Aib | Q | G | T | F | T | S | D | Nal(2) | S | K | Y | L | D | G | R | Lys(C12)-# | | |
| EU-A333 | 37 | H | Aib | Q | G | T | F | T | S | D | Nal(2) | S | K | Y | L | D | G | R | Lys(C16)-# | | |
| EU-A334 | 38 | H | Aib | Q | G | T | 2,6FF | T | S | D | Bip2Et4MeO | S | K | Y | L | D | G | R | Lys(C8)-# | | |
| EU-A335 | 39 | H | Aib | Q | G | T | 2,6FF | T | S | D | Bip2Et4MeO | S | K | Y | L | D | G | R | Lys(C12)-# | | |
| EU-A336 | 40 | H | Aib | Q | G | T | 2,6FF | T | S | D | Bip2Et4MeO | S | K | Y | L | D | G | R | Lys(C16)-# | | |
| EU-A337 | 41 | H | Aib | Q | G | T | F | T | S | D | L | Lys(C8)-# | | | | | | | | | |
| EU-A338 | 42 | H | Aib | Q | G | T | F | T | S | D | L | Lys(C12)-# | | | | | | | | | |
| EU-A339 | 43 | H | Aib | Q | G | T | F | T | S | D | L | Lys(C16)-# | | | | | | | | | |
| EU-A340 | 44 | H | Aib | Q | G | T | F | T | S | D | Bip | Lys(C8)-# | | | | | | | | | |
| EU-A341 | 45 | H | Aib | Q | G | T | F | T | S | D | Bip | Lys(C12)-# | | | | | | | | | |
| EU-A342 | 46 | H | Aib | Q | G | T | F | T | S | D | Bip | Lys(C16)-# | | | | | | | | | |
| EU-A343 | 47 | H | Aib | Q | G | T | F | T | S | D | Nal(2) | Lys(C8)-# | | | | | | | | | |
| EU-A344 | 48 | H | Aib | Q | G | T | F | T | S | D | Nal(2) | Lys(C12)-# | | | | | | | | | |
| EU-A345 | 49 | H | Aib | Q | G | T | F | T | S | D | Nal(2) | Lys(C16)-# | | | | | | | | | |
| EU-A346 | 50 | H | Aib | Q | G | T | 2,6FF | T | S | D | Bip2Et4MeO | Lys(C8)-# | | | | | | | | | |
| EU-A347 | 51 | H | Aib | Q | G | T | 2,6FF | T | S | D | Bip2Et4MeO | Lys(C12)-# | | | | | | | | | |
| EU-A348 | 52 | H | Aib | Q | G | T | 2,6FF | T | S | D | Bip2Et4MeO | Lys(C16)-# | | | | | | | | | |
| EU-A349 | 53 | H | Aib | Q | G | T | 2,6MeF | T | S | D | Bip | Lys(C8)-# | | | | | | | | | |
| EU-A350 | 54 | H | Aib | Q | G | T | 2,6MeF | T | S | D | Bip | Lys(C12)-# | | | | | | | | | |
| EU-A351 | 55 | H | Aib | Q | G | T | 2,6MeF | T | S | D | Bip | Lys(C16)-# | | | | | | | | | |
| EU-A352 | 56 | H | Aib | Q | G | T | MeF | T | S | D | L | S | K | Y | L | Lys(C8)-# | | | | | |
| EU-A353 | 57 | H | Aib | Q | G | T | MeF | T | S | D | L | S | K | Y | L | Lys(C12)-# | | | | | |
| EU-A354 | 58 | H | Aib | Q | G | T | MeF | T | S | D | L | S | K | Y | L | Lys(C16)-# | | | | | |
| EU-A355 | 59 | H | Aib | Q | G | T | MeF | T | S | D | Bip | S | K | Y | L | Lys(C8)-# | | | | | |
| EU-A356 | 60 | H | Aib | Q | G | T | MeF | T | S | D | Bip | S | K | Y | L | Lys(C12)-# | | | | | |
| EU-A357 | 61 | H | Aib | Q | G | T | MeF | T | S | D | Bip | S | K | Y | L | Lys(C16)-# | | | | | |
| EU-A358 | 62 | H | Aib | Q | G | T | MeF | T | S | D | Nal(2) | S | K | Y | L | Lys(C8)-# | | | | | |
| EU-A359 | 63 | H | Aib | Q | G | T | MeF | T | S | D | Nal(2) | S | K | Y | L | Lys(C12)-# | | | | | |
| EU-A360 | 64 | H | Aib | Q | G | T | MeF | T | S | D | Nal(2) | S | K | Y | L | Lys(C16)-# | | | | | |
| EU-A361 | 65 | H | Aib | Q | G | T | MeF | T | S | D | Bip2Et4MeO | S | K | Y | L | Lys(C8)-# | | | | | |

FIG. 1 (Continued)
Table 1 (Continued)

| | SEQ. ID. NO. | 1 | | | 5 | | | | | 10 | | | | | 15 | | | | | 20 |
|---|---|---|---|---|---|---|---|---|---|---|---|---|---|---|---|---|---|---|---|---|
| EU-A362 | 66 | H | Aib | Q | G | T | MeF | T | S | D | Bip2Et4MeO | S | K | Y | L | Lys(C12)-# | | | | |
| EU-A363 | 67 | H | Aib | Q | G | T | MeF | T | S | D | Bip2Et4MeO | S | K | Y | L | Lys(C16)-# | | | | |
| EU-A364 | 68 | H | Aib | Q | G | T | F | T | S | D | V | S | K | Y | L | E | S | Lys(C8)-# | | |
| EU-A365 | 69 | H | Aib | Q | G | T | F | T | S | D | L | S | K | Y | L | E | S | Lys(C8)-# | | |
| EU-A366 | 70 | H | Aib | Q | G | T | F | T | S | D | L | S | K | Y | L | E | S | Lys(C12)-# | | |
| EU-A367 | 71 | H | Aib | Q | G | T | F | T | S | D | L | S | K | Y | L | E | S | Lys(C16)-# | | |
| EU-A368 | 72 | H | Aib | Q | G | T | F | T | S | D | Bip | S | K | Y | L | E | S | Lys(C8)-# | | |
| EU-A369 | 73 | H | Aib | Q | G | T | F | T | S | D | Bip | S | K | Y | L | E | S | Lys(C12)-# | | |
| EU-A370 | 74 | H | Aib | Q | G | T | F | T | S | D | Bip | S | K | Y | L | E | S | Lys(C16)-# | | |
| EU-A371 | 75 | H | Aib | Q | G | T | F | T | S | D | Nal(2) | S | K | Y | L | E | S | Lys(C8)-# | | |
| EU-A372 | 76 | H | Aib | Q | G | T | F | T | S | D | Nal(2) | S | K | Y | L | E | S | Lys(C12)-# | | |
| EU-A373 | 77 | H | Aib | Q | G | T | F | T | S | D | Nal(2) | S | K | Y | L | E | S | Lys(C16)-# | | |
| EU-A374 | 78 | H | Aib | Q | G | T | 2,6FF | T | S | D | Bip2Et4MeO | S | K | Y | L | E | S | Lys(C8)-# | | |
| EU-A375 | 79 | H | Aib | Q | G | T | 2,6FF | T | S | D | Bip2Et4MeO | S | K | Y | L | E | S | Lys(C12)-# | | |
| EU-A376 | 80 | H | Aib | Q | G | T | 2,6FF | T | S | D | Bip2Et4MeO | S | K | Y | L | E | S | Lys(C16)-# | | |
| EU-A377 | 81 | H | Aib | Q | G | T | F | T | S | D | Bip | S | K | Y | L | D | S | Lys(C8)-# | | |
| EU-A378 | 82 | H | Aib | Q | G | T | F | T | S | D | Bip | S | K | Y | L | D | S | Lys(C12)-# | | |
| EU-A379 | 83 | H | Aib | Q | G | T | F | T | S | D | Bip | S | K | Y | L | D | S | Lys(C16)-# | | |
| EU-A380 | 84 | H | Aib | Q | G | T | F | T | S | D | Bip | S | K | Y | L | D | R | Lys(C8)-# | | |
| EU-A381 | 85 | H | Aib | Q | G | T | F | T | S | D | Bip | S | K | Y | L | D | R | Lys(C12)-# | | |
| EU-A382 | 86 | H | Aib | Q | G | T | F | T | S | D | Y | S | K | Y | L | D | R | Lys(C16)-# | | |
| EU-A383 | 87 | H | Aib | Q | G | T | F | T | S | D | Y | S | K | Y | L | D | R | Lys(C8)-# | | |
| EU-A384 | 88 | H | Aib | Q | G | T | F | T | S | D | Y | S | K | Y | L | D | R | Lys(C12)-# | | |
| EU-A385 | 89 | H | Aib | Q | G | T | F | T | S | D | Y | S | K | Y | L | D | R | Lys(C16)-# | | |
| EU-A386 | 90 | H | Aib | Q | G | T | F | T | S | D | Bip | S | K | Y | L | D | Har | Lys(C8)-# | | |
| EU-A387 | 91 | H | Aib | Q | G | T | F | T | S | D | Bip | S | K | Y | L | E | S | Lys(C12)-# | | |
| EU-A388 | 92 | H | Aib | Q | G | T | MeF | T | S | D | Bip | S | K | Y | L | E | S | Lys(C12)-# | | |
| EU-A389 | 93 | H | Aib | Q | G | T | MeF | T | S | D | Bip | S | Aib | Y | L | E | S | Lys(C12)-# | | |
| EU-A390 | 94 | H | Aib | Q | G | T | MeF | T | S | D | Bip | S | K | Y | L | E | Aib | Lys(C12)-# | | |
| EU-A391 | 95 | H | Aib | Q | G | T | MeF | T | S | D | Y | Aib | K | Y | L | D | Aib | Lys(C12)-# | | |
| EU-A392 | 96 | H | Aib | Q | G | T | MeF | T | S | D | Y | S | K | Y | L | D | Aib | Lys(C12)-# | | |

FIG. 1 (Continued)
Table 1 (Continued)

| | SEQ. ID. NO. | 1 | | | | 5 | | | | | 10 | | | | | 15 | | | | | 20 |
|---|---|---|---|---|---|---|---|---|---|---|---|---|---|---|---|---|---|---|---|---|---|
| EU-A393 | 97 | H | Aib | Q | G | T | MeF | T | S | D | Y | | | K | Lys(C12)-# | | | | | | |
| EU-A394 | 98 | H | Aib | Q | G | T | MeF | T | S | D | Nal(2) | | | K | Lys(C12)-# | | | | | | |
| EU-A395 | 99 | H | Aib | Q | G | T | MeF | T | S | D | Y | S | | K | Y | L | D | Aib | Lys(C12) | Aib-# | |
| EU-A396 | 100 | H | Aib | Q | G | T | MeF | T | S | D | Nal(2) | S | | K | Y | L | D | Aib | Lys(C12) | Aib-# | |
| EU-A397 | 101 | H | Aib | Q | G | T | MeF | T | S | D | Y | Aib | | K | Y | L | D | Aib | Lys(C12)-# | | |
| EU-A398 | 102 | H | Aib | Q | G | T | MeF | T | S | D | Y | Aib | | K | Y | L | D | Aib | Lys(C12) | Aib-# | |
| EU-A399 | 103 | H | Aib | Q | G | T | MeF | T | S | D | Y | S | | K | Y | L | D | Aib | Lys(C12) | Aib-# | |
| EU-A400 | 104 | H | Aib | Q | G | T | MeF | T | S | D | Y | Aib | | K | Y | L | D | R | Aib | Lys(C12) | Aib-# |
| EU-A401 | 105 | H | Aib | Q | G | T | MeF | T | S | D | Y | Aib | | K | Y | L | D | R | Aib | Lys(C12) | Aib-# |
| EU-A402 | 106 | H | Aib | Q | G | T | MeF | T | S | D | Y | Aib | | K | Y | L | D | R | Aib | Lys(C12) | Ac5c-# |
| EU-A403 | 107 | H | Aib | Q | G | T | MeF | T | S | D | Nal(2) | Aib | | K | Y | L | E | R | Aib | Lys(C12)-# | |
| EU-A404 | 108 | H | Aib | Q | G | T | F | T | S | D | Y | S | | K | Y | L | D | Har | Aib | Lys(C8) | Aib-# |
| EU-A405 | 109 | H | Aib | Q | G | T | F | T | S | D | Y | S | | K | Y | L | D | Har | Aib | Lys(C12) | Aib-# |
| EU-A406 | 110 | H | Aib | Q | G | T | F | T | S | D | Y | S | | K | Y | L | D | Har | Aib | Lys(C16) | Aib-# |
| EU-A407 | 111 | H | Aib | Q | G | T | MeF | T | S | D | Y | Aib | | K | Y | Lys(C12)-# | -NHEt | | | | |
| EU-A408 | 112 | H | Aib | Q | G | T | MeF | T | S | D | Y | Aib | | K | Y | L | Aib-# | | | | |
| EU-A409 | 113 | H | Aib | Q | G | T | MeF | T | S | D | Y | Aib | | K | Y | L | Ac5c-# | | | | |
| EU-A410 | 114 | H | Aib | Q | G | T | MeF | T | S | D | Y | Aib | | K | Y | L | Aib | Lys(C8)-# | | | |
| EU-A411 | 115 | H | Aib | Q | G | T | MeF | T | S | D | Y | Aib | | K | Y | L | Aib | Lys(C16)-# | | | |
| EU-A412 | 116 | H | Aib | Q | G | T | MeF | T | S | D | Y | S | | K | Y | L | D | Aib | Lys(C8)-# | | |
| EU-A413 | 117 | H | Aib | Q | G | T | MeF | T | S | D | Y | S | | K | Y | L | D | Aib | Lys(C16)-# | | |
| EU-A414 | 118 | H | Aib | Q | G | T | F | T | S | D | Y | S | | K | Y | L | D | Aib | Lys(C8)-# | | |
| EU-A415 | 119 | H | Aib | Q | G | T | F | T | S | D | Y | S | | K | Y | L | D | Aib | Lys(C12)-# | | |
| EU-A416 | 120 | H | Aib | Q | G | T | F | T | S | D | Y | S | | K | Y | L | D | Aib | Lys(C16)-# | | |
| EU-A417 | 121 | H | Aib | Q | G | T | MeF | T | S | D | Y | S | | K | Y | L | D | S | Aib | Lys(C8) | Aib-# |
| EU-A418 | 122 | H | Aib | Q | G | T | MeF | T | S | D | Y | S | | K | Y | L | D | S | Aib | Lys(C12) | Aib-# |
| EU-A419 | 123 | H | Aib | Q | G | T | MeF | T | S | D | Y | S | | K | Y | L | D | S | Aib | Lys(C16) | Aib-# |
| EU-A420 | 124 | H | Aib | Q | G | T | MeF | T | S | D | Y | S | | K | Y | L | D | S | Aib | Lys(C8) | Ac5c-# |
| EU-A421 | 125 | H | Aib | Q | G | T | MeF | T | S | D | Y | S | | K | Y | L | D | S | Aib | Lys(C12) | Ac5c-# |
| EU-A422 | 126 | H | Aib | Q | G | T | MeF | T | S | D | Y | S | | K | Y | L | D | S | Aib | Lys(C16) | Ac5c-# |
| EU-A423 | 127 | H | Aib | Q | G | T | F | T | S | D | Y | S | | K | Y | L | D | S | Aib | Lys(C8) | Ac5c-# |

FIG. 1 (Continued)
Table 1 (Continued)

| | SEQ. ID. NO. | 1 | | | | 5 | | | | | 10 | | | | | 15 | | | | | 20 |
|---|---|---|---|---|---|---|---|---|---|---|---|---|---|---|---|---|---|---|---|---|---|
| EU-A424 | 128 | H | Aib | Q | G | T | F | T | S | D | Y | S | K | Y | L | D | S | Aib | Lys(C12) | Ac5c-# |
| EU-A425 | 129 | H | Aib | Q | G | T | F | T | S | D | Y | S | K | Y | L | D | S | Aib | Lys(C16) | Ac5c-# |

MeF means C-alphaMe-Phe; Har means homoArg; 2,6F-F means 2',6'-difluoro-Phe; Bip2Et4MeO means 2'-ethyl-4'-MeO-biphenylalanine.

Lys(C12) means N-epsilon-(1'-dodecyl beta-D-glucuronyl)-L-lysine and other C numbers mean the corresponding 1'-alkyl glucoronide.

\# means amide C-terminus.

FIG. 2
Table 2

| | SEQ. ID. NO. | 1 | | | | 5 | | | | | 10 | | | | | 15 | | | | | 20 | | | | | 25 |
|---|---|---|---|---|---|---|---|---|---|---|---|---|---|---|---|---|---|---|---|---|---|---|---|---|---|---|
| EU-A426 | 130 | H | Aib | Q | G | T | MeF | T | S | D | Y | S | K | Y | L | D | S | R | Aib | Lys(C8) | Aib-# | | | | |
| EU-A427 | 131 | H | Aib | Q | G | T | MeF | T | S | D | Y | S | K | Y | L | D | S | R | Aib | Lys(C12) | Aib-# | | | | |
| EU-A428 | 132 | H | Aib | Q | G | T | MeF | T | S | D | Y | S | K | Y | L | D | S | R | Aib | Lys(C16) | Aib-# | | | | |
| EU-A429 | 133 | H | Aib | Q | G | T | MeF | T | S | D | Y | S | K | Y | L | D | S | R | Aib | Lys(C8) | Ac5c-# | | | | |
| EU-A430 | 134 | H | Aib | Q | G | T | MeF | T | S | D | Y | S | K | Y | L | D | S | R | Aib | Lys(C12) | Ac5c-# | | | | |
| EU-A431 | 135 | H | Aib | Q | G | T | MeF | T | S | D | Y | S | K | Y | L | D | S | R | Aib | Lys(C16) | Ac5c-# | | | | |
| EU-A432 | 136 | H | Aib | Q | G | T | F | T | S | D | Y | S | K | Y | L | D | S | R | Aib | Lys(C8) | Aib-# | | | | |
| EU-A433 | 137 | H | Aib | Q | G | T | F | T | S | D | Y | S | K | Y | L | D | S | R | Aib | Lys(C12) | Aib-# | | | | |
| EU-A434 | 138 | H | Aib | Q | G | T | F | T | S | D | Y | S | K | Y | L | D | S | R | Aib | Lys(C16) | Aib-# | | | | |
| EU-A435 | 139 | H | Aib | Q | G | T | MeF | T | S | D | Y | S | K | Y | L | D | S | R | Aib | Ala | Q | Lys(C8) | F | Aib-# | |
| EU-A436 | 140 | H | Aib | Q | G | T | MeF | T | S | D | Y | S | K | Y | L | D | S | R | Aib | Ala | Q | Lys(C12) | F | Aib-# | |
| EU-A437 | 141 | H | Aib | Q | G | T | MeF | T | S | D | Y | S | K | Y | L | D | S | R | Aib | Ala | Q | Lys(C16) | F | Aib-# | |
| EU-A438 | 142 | H | Aib | Q | G | T | MeF | T | S | D | Y | S | K | Y | L | D | S | R | Aib | Ala | Q | Lys(C8) | F | Ac5c-# | |
| EU-A439 | 143 | H | Aib | Q | G | T | MeF | T | S | D | Y | S | K | Y | L | D | S | R | Aib | Ala | Q | Lys(C12) | F | Ac5c-# | |
| EU-A440 | 144 | H | Aib | Q | G | T | MeF | T | S | D | Y | S | K | Y | L | D | S | R | Aib | Ala | Q | Lys(C16) | F | Ac5c-# | |
| EU-A441 | 145 | H | Aib | Q | G | T | MeF | T | S | D | Y | S | K | Y | L | D | S | R | Aib | Ala | Q | Lys(C8) | F | Aib-# | |
| EU-A435 | 146 | H | Aib | Q | G | T | MeF | T | S | D | Y | S | K | Y | L | D | S | R | Aib | Ala | Q | Lys(C12) | F | Aib-# | |
| EU-A436 | 147 | H | Aib | Q | G | T | MeF | T | S | D | Y | S | K | Y | L | D | S | R | Aib | Ala | Q | Lys(C16) | F | Aib-# | |
| EU-A437 | 148 | H | Aib | Q | G | T | MeF | T | S | D | Y | E* | K | Y | L | D | K* | R | Aib | Ala | Q | Lys(C8) | F | Ac5c-# | |
| EU-A438 | 149 | H | Aib | Q | G | T | MeF | T | S | D | Y | S | E* | Y | L | D | K* | R | Aib | Ala | Q | Lys(C12) | F | Ac5c-# | |
| EU-A439 | 150 | H | Aib | Q | G | T | MeF | T | S | D | Y | S | E* | Y | L | D | K* | R | Aib | Ala | Q | Lys(C16) | F | Ac5c-# | |
| EU-A440 | 151 | H | Aib | Q | G | T | MeF | T | S | D | Y | S | E* | Y | L | D | K* | R | Aib | Ala | Q | Lys(C8) | F | Aib-# | |
| EU-A441 | 152 | H | Aib | Q | G | T | MeF | T | S | D | Y | S | E* | Y | L | D | K* | R | Aib | Ala | Q | Lys(C12) | F | Aib-# | |
| EU-A442 | 153 | H | Aib | Q | G | T | MeF | T | S | D | Y | S | E* | Y | L | D | K* | R | Aib | Ala | Q | Lys(C16) | F | Aib-# | |
| EU-A443 | 154 | H | Aib | Q | G | T | F | T | S | D | Y | S | E* | Y | L | D | K* | R | Aib | Ala | Q | Lys(C8) | F | Ac5c-# | |
| EU-A444 | 155 | H | Aib | Q | G | T | F | T | S | D | Y | S | E* | Y | L | D | K* | R | Aib | Ala | Q | Lys(C12) | F | Ac5c-# | |
| EU-A445 | 156 | H | Aib | Q | G | T | F | T | S | D | Y | S | E* | Y | L | D | K* | R | Aib | Ala | Q | Lys(C16) | F | Ac5c-# | |
| EU-A446 | 157 | H | Aib | Q | G | T | F | T | S | D | Y | S | K | Y | L | D | K* | R | Aib | Ala | Q | Lys(C8) | F | Aib-# | |
| EU-A447 | 158 | H | Aib | Q | G | T | F | T | S | D | Y | S | K | Y | L | D | E* | R | Aib | Ala | Q | Lys(C12) | F | Aib-# | |
| EU-A448 | 159 | H | Aib | Q | G | T | F | T | S | D | Y | S | K | Y | L | D | E* | R | Aib | Ala | Q | Lys(C16) | F | Aib-# | |
| EU-A449 | 160 | H | Aib | Q | G | T | MeF | T | S | D | Y | S | K | Y | L | D | E* | R | Aib | Ala | K* | Lys(C8) | F | Aib-# | |
| EU-A448 | 161 | H | Aib | Q | G | T | MeF | T | S | D | Y | S | K | Y | L | D | E* | R | Aib | Ala | K* | Lys(C12) | F | Aib-# | |
| EU-A449 | 162 | H | Aib | Q | G | T | MeF | T | S | D | Y | S | K | Y | L | D | E* | R | Aib | Ala | K* | Lys(C16) | F | Aib-# | |

FIG. 2 (Continued)
Table 2 (Continued)

| | SEQ. ID. NO. | 1 | | | | 5 | | | | | 10 | | | | | 15 | | | | | 20 | | | | | 25 |
|---|---|---|---|---|---|---|---|---|---|---|---|---|---|---|---|---|---|---|---|---|---|---|---|---|---|---|
| EU-A450 | 163 | H | Aib | Q | G | T | MeF | T | S | D | Y | S | K | Y | L | D | E* | R | | Aib | Ala | K* | Lys(C8) | F | Ac5c-# | |
| EU-A451 | 164 | H | Aib | Q | G | T | MeF | T | S | D | Y | S | K | Y | L | D | K* | R | | Aib | Ala | K* | Lys(C12) | F | Ac5c-# | |
| EU-A452 | 165 | H | Aib | Q | G | T | MeF | T | S | D | Y | S | K | Y | L | D | K* | R | | Aib | Ala | K* | Lys(C16) | F | Ac5c-# | |
| EU-A447 | 166 | H | Aib | Q | G | T | F | T | S | D | Y | S | K | Y | L | D | K* | R | | Aib | Ala | K* | Lys(C8) | F | Aib-# | |
| EU-A448 | 167 | H | Aib | Q | G | T | F | T | S | D | Y | S | K | Y | L | D | E* | R | | Aib | Ala | K* | Lys(C12) | F | Aib-# | |
| EU-A449 | 168 | H | Aib | Q | G | T | F | T | S | D | Y | S | K | Y | L | D | E* | R | | Aib | Ala | K* | Lys(C16) | F | Aib-# | |
| EU-A450 | 169 | H | Aib | Q | G | T | F | T | S | D | Y | S | K | Y | L | D | E* | R | | Aib | Ala | K* | Lys(C8) | F | Ac5c-# | |
| EU-A451 | 170 | H | Aib | Q | G | T | F | T | S | D | Y | S | K | Y | L | D | K* | R | | Aib | Ala | K* | Lys(C12) | F | Ac5c-# | |
| EU-A452 | 171 | H | Aib | Q | G | T | F | T | S | D | Y | S | K | Y | L | D | K* | R | | Aib | Ala | K* | Lys(C16) | F | Ac5c-# | |
| EU-A453 | 172 | H | Aib | Q | G | T | F | T | S | D | Y | S | K | Y | L | D | E* | Q | | Aib | A | K* | Lys(C12) | F | Aib-# | |
| EU-A454 | 173 | H | Aib | Q | G | T | F | T | S | D | Y | S | K | Y | L | D | E* | Q | | Aib | A | K* | Lys(C16) | F | Aib-# | |
| EU-A455 | 174 | H | Aib | Q | G | T | F | T | S | D | Y | S | K | Y | L | D | K* | R | | A | A | K* | Lys(C12) | F | Aib-# | |
| EU-A456 | 175 | H | Aib | Q | G | T | F | T | S | D | Y | S | K | Y | L | D | E* | R | | A | A | K* | Lys(C16) | F | Aib-# | |
| EU-A457 | 176 | H | Aib | Q | G | T | F | T | S | D | Y | S | K | Y | L | D | E* | Q | | A | A | K* | Lys(C12) | F | Ac5c-# | |
| EU-A458 | 177 | H | Aib | Q | G | T | F | T | S | D | Y | S | K | Y | L | D | E* | Q | | A | A | K* | Lys(C16) | F | Ac5c-# | |
| EU-A459 | 178 | H | Aib | Q | G | T | F | T | S | D | Y | S | K | Y | L | D | E* | Q | | A | A | K* | Lys(C12) | F | Ac5c-# | |
| EU-A460 | 179 | H | Aib | Q | G | T | F | T | S | D | Y | S | R | Y | L | D | E* | R | | A | A | K* | Lys(C12) | F | Aib-# | |
| EU-A461 | 180 | H | Aib | Q | G | T | F | T | S | D | Y | S | K | Y | L | D | S | Aib | | Lys(C12) | Aib-# | | | | | |
| EU-A462 | 181 | H | Aib | Q | G | T | F | T | S | D | Y | S | K* | Y | L | D | S | R | | Lys(C12) | Aib-# | | | | | |
| EU-A463 | 182 | H | Aib | Q | G | T | F | T | S | D | Y | S | K* | Y | L | D | S | R | | Lys(C8) | Ac5c-# | | | | | |
| EU-A464 | 183 | H | Aib | Q | G | T | F | T | S | D | Y | S | K* | Y | L | D | S | R | | Lys(C16) | Aib-# | | | | | |
| EU-A465 | 184 | H | Aib | Q | G | T | F | T | S | D | Y | S | K* | Y | L | D | S | R | | Lys(C12) | Aib-# | | | | | |
| EU-A466 | 185 | H | Aib | Q | G | T | F | T | S | D | Y | S | K* | Y | L | D | S | Aib | | Lys(C1) | Aib-# | | | | | |
| EU-A467 | 186 | H | Aib | Q | G | T | F | T | S | D | Y | S | K* | Y | L | D | S | Aib | | Lys(C16) | Aib-# | | | | | |
| EU-A468 | 187 | H | Aib | Q | G | T | F | T | S | D | Y | S | K* | Y | L | D | S | Aib | | Lys(C16) | Aib-# | | | | | |
| EU-A469 | 188 | H | Aib | Q | G | T | F | T | S | D | Y | S | K* | Y | L | D | S | Aib | | Lys(C12) | Aib-# | | | | | |
| EU-A470 | 189 | H | Aib | Q | G | T | F | T | S | D | Y | S | K* | Y | L | D | S | Aib | | Lys(C8) | Aib-# | | | | | |
| EU-A471 | 190 | H | Aib | Q | G | T | F | T | S | D | Y | S | K* | Y | L | D | E* | Aib | | Lys(C16) | Aib-# | | | | | |
| EU-A472 | 191 | H | Aib | Q | G | T | F | T | S | D | Y | S | K* | Y | L | D | E* | R | | Lys(C12) | Aib-# | | | | | |
| EU-A473 | 192 | H | Aib | Q | G | T | F | T | S | D | Y | S | K* | Y | L | D | E* | R | | Lys(C8) | Aib-# | | | | | |
| EU-A474 | 193 | H | Aib | Q | G | T | F | T | S | D | Y | S | K* | Y | L | D | E* | R | | Lys(C16) | Aib-# | | | | | |
| EU-A475 | 194 | H | Aib | Q | G | T | F | T | S | D | Y | S | K | Y | L | D | E* | R | | Lys(C12) | Aib-# | | | | | |
| EU-A476 | 195 | H | Aib | Q | G | T | F | T | S | D | Y | S | K | Y | L | D | E* | R | | Lys(C8) | Ac5c-# | | | | | |
| EU-A477 | 196 | H | Aib | Q | G | T | F | T | S | D | Y | S | K | Y | L | D | R | Aib | | Lys(C8) | # | | | | | |
| EU-A478 | 197 | H | Aib | Q | G | T | F | T | S | D | Y | S | K | Y | L | D | R | Aib | | Lys(C12) | # | | | | | |
| EU-A479 | 198 | H | Aib | Q | G | T | F | T | S | D | Y | S | K | Y | L | D | R | Aib | | Lys(C16) | # | | | | | |

FIG. 2 (Continued)
Table 2 (Continued)

| | SEQ. ID. NO. | 1 | | | | 5 | | | | | 10 | | | | | 15 | | | | | 20 | | | | | 25 |
|---|---|---|---|---|---|---|---|---|---|---|---|---|---|---|---|---|---|---|---|---|---|---|---|---|---|---|
| EU-A480 | 199 | H | Aib | Q | G | T | F | T | S | D | Y | S | K | Y | L | D | S | R | Aib | Lys(C8) | # | | | | |
| EU-A481 | 200 | H | Aib | Q | G | T | F | T | S | D | Y | S | K | Y | L | D | S | R | Aib | Lys(C12) | # | | | | |
| EU-A482 | 201 | H | Aib | Q | G | T | F | T | S | D | Y | S | K | Y | L | D | S | R | Aib | Lys(C16) | # | | | | |
| EU-A483 | 202 | H | Aib | Q | G | T | F | T | S | D | Y | S | K | Y | L | D | Aib | R | Aib | Lys(C8) | # | | | | |
| EU-A484 | 203 | H | Aib | Q | G | T | F | T | S | D | Y | S | K | Y | L | D | Aib | R | Aib | Lys(C12) | # | | | | |
| EU-A485 | 204 | H | Aib | Q | G | T | F | T | S | D | Y | S | K | Y | L | D | Aib | R | Aib | Lys(C16) | # | | | | |
| EU-A486 | 205 | H | Aib | Q | G | T | F | T | S | D | V | S | S | Y | L | E | R | Aib | Lys(C8) | # | | | | | |
| EU-A487 | 206 | H | Aib | Q | G | T | F | T | S | D | V | S | S | Y | L | E | R | Aib | Lys(C12) | # | | | | | |
| EU-A488 | 207 | H | Aib | Q | G | T | F | T | S | D | V | S | S | Y | L | E | R | Aib | Lys(C16) | # | | | | | |
| EU-A489 | 208 | H | Aib | Q | G | T | F | T | S | D | V | S | S | Y | L | E | Aib | R | Lys(C8) | # | | | | | |
| EU-A490 | 209 | H | Aib | Q | G | T | F | T | S | D | V | S | S | Y | L | E | Aib | R | Lys(C12) | # | | | | | |
| EU-A491 | 210 | H | Aib | Q | G | T | F | T | S | D | V | S | S | Y | L | E | Aib | R | Lys(C16) | # | | | | | |
| EU-A492 | 211 | H | Aib | Q | G | T | F | T | S | D | Y | S | K | Y | L | D | hArg | Aib | Lys(C8) | # | | | | | |
| EU-A493 | 212 | H | Aib | Q | G | T | F | T | S | D | Y | S | K | Y | L | D | hArg | Aib | Lys(C12) | # | | | | | |
| EU-A494 | 213 | H | Aib | Q | G | T | F | T | S | D | Y | S | K | Y | L | D | hArg | Aib | Lys(C16) | # | | | | | |
| EU-A495 | 214 | H | Aib | Q | G | T | F | T | S | D | Y | S | K | Y | L | D | Aib | hArg | Aib | Lys(C8) | # | | | | |
| EU-A496 | 215 | H | Aib | Q | G | T | F | T | S | D | Y | S | K | Y | L | D | Aib | hArg | Aib | Lys(C12) | # | | | | |
| EU-A497 | 216 | H | Aib | Q | G | T | F | T | S | D | Y | S | K | Y | L | D | Aib | hArg | Aib | Lys(C16) | # | | | | |
| EU-A498 | 217 | H | Aib | Q | G | T | F | T | S | D | V | S | S | Y | L | E | hArg | Aib | Lys(C8) | # | | | | | |
| EU-A499 | 218 | H | Aib | Q | G | T | F | T | S | D | V | S | S | Y | L | E | hArg | Aib | Lys(C12) | # | | | | | |

FIG. 2 (Continued)
Table 2 (Continued)

| | SEQ. ID. NO. | 1 | | | | 5 | | | | | 10 | | | | | 15 | | | | | 20 | | | | 25 | | | | |
|---|---|---|---|---|---|---|---|---|---|---|---|---|---|---|---|---|---|---|---|---|---|---|---|---|---|---|---|---|---|
| EU-A501 | 219 | H | S | Q | G | T | F | T | S | D | Y | S | K | Y | L | D | S | R | R | A | Q | Lys(C12) | Aib | # | | | | | |
| EU-A502 | 220 | H | S | Q | G | T | F | T | S | D | Y | S | K | Y | L | D | S | R | R | A | Lys(C12) | Aib | # | | | | | | |
| EU-A503 | 221 | H | S | Q | G | T | F | T | S | D | Y | S | K | Y | L | D | S | R | R | Lys(C12) | Aib | # | | | | | | | |
| EU-A504 | 222 | H | S | Q | G | T | F | T | S | D | Y | S | K | Y | L | D | S | R | Lys(C12) | Aib | # | | | | | | | | |
| EU-A505 | 223 | H | S | Q | G | T | F | T | S | D | Y | S | K | Y | L | D | S | Lys(C12) | Aib | # | | | | | | | | | |
| EU-A506 | 224 | H | S | Q | G | T | F | T | S | D | Y | S | K | Y | L | D | Lys(C12) | Aib | # | | | | | | | | | | |
| EU-A507 | 225 | H | Aib | Q | G | T | F | T | S | D | Y | S | K | Y | L | D | E* | Q | A | A | K* | E | F | I | Lys(C12) | W | L | M | N | T# |
| EU-A509 | 226 | H | S | Q | G | T | F | T | S | D | Y | S | K | Y | L | D | S | R | R | A | Q | Lys(C12) | # | | | | | | |
| EU-A510 | 227 | H | S | Q | G | T | F | T | S | D | Y | S | K | Y | L | D | S | R | R | A | Lys(C12) | # | | | | | | | |
| EU-A511 | 228 | H | S | Q | G | T | F | T | S | D | Y | S | K | Y | L | D | S | R | R | Lys(C12) | # | | | | | | | | |
| EU-A512 | 229 | H | S | Q | G | T | F | T | S | D | Y | S | K | Y | L | D | S | Lys(C12) | # | | | | | | | | | | |
| EU-A513 | 230 | H | S | Q | G | T | F | T | S | D | Y | S | K | Y | L | D | Lys(C12) | # | | | | | | | | | | | |
| EU-A514 | 231 | H | S | Q | G | T | F | T | S | D | Y | S | K | Y | L | E | G | Q | A | A | Q | Lys(C12) | Aib | # | | | | | |
| EU-A515 | 232 | H | A | E | G | T | F | T | S | D | V | S | S | Y | L | E | G | Q | A | A | Lys(C12) | Aib | # | | | | | | |
| EU-A516 | 233 | H | A | E | G | T | F | T | S | D | V | S | S | Y | L | E | G | Q | A | Lys(C12) | Aib | # | | | | | | | |
| EU-A517 | 234 | H | A | E | G | T | F | T | S | D | V | S | S | Y | L | E | G | Lys(C12) | # | | | | | | | | | | |
| EU-A518 | 235 | H | A | E | G | T | F | T | S | D | V | S | S | Y | L | E | Lys(C12) | Aib | # | | | | | | | | | | |
| EU-A519 | 236 | H | A | E | G | T | F | T | S | D | V | S | S | Y | L | Lys(C12) | Aib | # | | | | | | | | | | | |
| EU-A520 | 237 | H | A | E | G | T | F | T | S | D | V | S | S | Y | L | E | Lys(C12) | Ac4c | Aib | # | | | | | | | | | |
| EU-A521 | 238 | H | Aib | Q | G | T | F | T | S | D | Y | S | K | Y | L | D | Lys(C12) | Ac4c | Aib | # | | | | | | | | | |
| EU-A522 | 239 | H | Aib | Q | G | T | F | T | S | D | Y | S | K | Y | L | D | Lys(C12) | R | R | R | # | | | | | | | | |
| EU-A523 | 240 | H | Aib | Q | G | T | F | T | S | D | Y | S | K | Y | L | D | Lys(C12) | R | Aib | # | | | | | | | | | |
| EU-A524 | 241 | H | Aib | Q | G | T | F | T | S | D | Y | S | K | Y | L | D | Lys(C12) | R | Aib | # | | | | | | | | | |
| EU-A525 | 242 | H | Aib | Q | G | T | F | T | S | D | Y | S | K | Y | L | D | S | hArg | hArg | Aib | # | | | | | | | | |
| EU-A526 | 243 | H | Aib | Q | G | T | F | T | S | D | Y | S | K | Y | L | D | S | Lys(C12) | Ac4c | Aib | | | | | | | | | |
| EU-A527 | 244 | H | Aib | Q | G | T | F | T | S | D | Y | S | K | Y | L | D | S | Lys(C12) | R | Aib | # | | | | | | | | |
| EU-A528 | 245 | H | Aib | Q | G | T | F | T | S | D | Y | S | K | Y | L | D | S | Lys(C12) | hArg | Aib | | | | | | | | | |
| EU-A529 | 246 | H | Aib | Q | G | T | F | T | S | D | Y | S | K | Y | L | D | S | R | Lys(C12) | Ac4c | # | | | | | | | | |
| EU-A530 | 247 | H | Aib | Q | G | T | F | T | S | D | Y | S | K | Y | L | D | S | R | Lys(C12) | Aib | # | | | | | | | | |
| EU-A531 | 248 | H | Aib | Q | G | T | F | T | S | D | Y | S | K | Y | L | D | S | R | Lys(C12) | Aib | # | | | | | | | | |
| EU-A532 | 249 | H | Aib | Q | G | T | F | T | S | D | Y | S | K | Y | L | D | S | R | Ac4c | Ac4c | # | | | | | | | | |
| EU-A533 | 250 | H | Aib | Q | G | T | F | T | S | D | Y | S | K | Y | L | D | S | hArg | Lys(C12) | Aib | | | | | | | | | |

FIG. 2 (Continued)
Table 2 (Continued)

| | SEQ. ID. NO. | 1 | | | | 5 | | | | | 10 | | | | | 15 | | | | | 20 | | | | | 25 |
|---|---|---|---|---|---|---|---|---|---|---|---|---|---|---|---|---|---|---|---|---|---|---|---|---|---|---|
| EU-A534 | 251 | H | Aib | Q | G | T | F | T | S | D | Y | S | K | Y | L | D | Aib | R | Lys(C12) | Aib | # | | | | | |
| EU-A535 | 252 | H | Aib | Q | G | T | F | T | S | D | Y | S | K | Y | L | D | S | R | Lys(C14) | Aib | # | | | | | |
| EU-A536 | 253 | H | Aib | Q | G | T | F | T | S | D | Y | S | K | Y | L | D | S | R | Lys(C16) | Aib | # | | | | | |
| EU-A537 | 254 | H | Aib | Q | G | T | F | T | S | D | Y | S | K | Y | L | D | S | R | Lys(C18) | Aib | # | | | | | |
| EU-A538 | 255 | H | Aib | Q | G | T | F | T | S | D | Y | S | K | Y | L | D | Aib | R | Lys(C12) | Aib | # | | | | | |
| EU-A539 | 256 | H | Aib | Q | G | T | F | T | S | D | Y | S | K* | Y | L | D | E* | Q | Lys(C14) | A | K* | # | | | | |
| EU-A540 | 257 | H | Aib | Q | G | T | F | T | S | D | Y | S | K* | Y | L | D | E* | Q | Lys(C16) | A | K* | # | | | | |
| EU-A541 | 258 | H | Aib | Q | G | T | F | T | S | D | Y | S | K* | Y | L | D | E* | Q | Lys(C18) | A | K* | # | | | | |
| EU-A542 | 259 | H | Aib | Q | G | T | F | T | S | D | Y | S | K* | Y | L | D | E* | Q | Lys(C20) | A | K* | # | | | | |
| EU-A543 | 260 | H | Aib | Q | G | T | F | T | S | D | Y | S | K | Y | L | D | E* | Q | Lys(C12) | A | Alb | | | | | |
| EU-A544 | 261 | H | Aib | Q | G | T | F | T | S | D | Y | S | K | Y | L | D | S | R | Lys(C14) | Aib | Alb | | | | | |
| EU-A545 | 262 | H | Aib | Q | G | T | F | T | S | D | Y | S | K | Y | L | D | S | R | Lys(C16) | Aib | Alb | | | | | |
| EU-A546 | 263 | H | Aib | Q | G | T | F | T | S | D | Y | S | K | Y | L | D | S | R | Lys(C18) | Aib | Alb | | | | | |
| EU-A547 | 264 | H | Aib | Q | G | T | F | T | S | D | Y | S | K | Y | L | D | S | R | Lys(C20) | Aib | Alb | | | | | |
| EU-A548 | 265 | H | Aib | Q | G | T | F | T | S | D | Y | S | K | Y | L | D | S | R | Lys(C12) | Aib | | | | | | |
| EU-A549 | 267 | H | Aib | Q | G | T | F | T | S | D | Y | S | K | Y | L | D | Aib | Aib | Lys(C14) | # | | | | | | |
| EU-A550 | 268 | H | Aib | Q | G | T | F | T | S | D | Y | S | K | Y | L | D | Aib | Aib | Lys(C16) | # | | | | | | |
| EU-A551 | 269 | H | Aib | Q | G | T | F | T | S | D | Y | S | K | Y | L | D | Aib | Aib | Lys(C18) | # | | | | | | |
| EU-A552 | 270 | H | Aib | Q | G | T | F | T | S | D | Y | S | K | Y | L | D | Aib | Aib | Lys(C20) | # | | | | | | |
| EU-A553 | 271 | H | Aib | Q | G | T | F | T | S | D | Y | S | K | Y | L | D | Aib | Aib | Lys(C12) | # | | | | | | |
| EU-A554 | 272 | H | Aib | Q | G | T | F | T | S | D | Y | S | K | Y | L | D | S | Aib | Lys(C14) | Aib | Alb | # | | | | |
| EU-A555 | 273 | H | Aib | Q | G | T | F | T | S | D | Y | S | K | Y | L | D | S | Aib | Lys(C16) | Aib | Alb | # | | | | |
| EU-A556 | 274 | H | Aib | Q | G | T | F | T | S | D | Y | S | K | Y | L | D | S | Aib | Lys(C18) | Aib | Alb | # | | | | |
| EU-A557 | 275 | H | Aib | Q | G | T | F | T | S | D | Y | S | K | Y | L | D | S | Aib | Lys(C20) | Aib | Alb | # | | | | |
| EU-A558 | 276 | H | Aib | Q | G | T | F | T | S | D | Y | S | K | Y | L | D | S | Aib | Lys(C22) | Aib | Alb | # | | | | |
| EU-A559 | 277 | H | Aib | Q | G | T | F | T | S | D | Y | S | K | Y | L | D | S | Aib | Lys(C12) | Aib | Alb | # | | | | |
| EU-A560 | 278 | H | Aib | Q | G | T | F | T | S | D | Y | S | K* | Y | L | D | E* | R | Lys(C14) | Aib | # | | | | | |
| EU-A561 | 279 | H | Aib | Q | G | T | F | T | S | D | Y | S | K* | Y | L | D | E* | R | Lys(C16) | Aib | # | | | | | |
| EU-A562 | 280 | H | Aib | Q | G | T | F | T | S | D | Y | S | K* | Y | L | D | E* | R | Lys(C18) | Aib | # | | | | | |
| EU-A563 | 281 | H | Aib | Q | G | T | F | T | S | D | Y | S | K* | Y | L | D | E* | R | Lys(C12) | Aib | # | | | | | |
| EU-A564 | 282 | H | Aib | Q | G | T | F | T | S | D | Y | S | K* | Y | L | D | E* | R | Lys(C20) | Aib | # | | | | | |
| EU-A565 | 283 | H | Aib | Q | G | T | F | T | S | D | Y | S | K* | Y | L | D | E* | Q | Lys(C12) | Aib | # | | | | | |
| EU-A566 | 284 | H | Aib | Q | G | T | F | T | S | D | Y | S | K* | Y | L | D | E* | Q | Lys(C14) | Aib | # | | | | | |
| EU-A567 | 285 | H | Aib | Q | G | T | F | T | S | D | Y | S | K* | Y | L | D | E* | Q | Lys(C16) | Aib | # | | | | | |
| EU-A568 | 286 | H | Aib | Q | G | T | F | T | S | D | Y | S | K* | Y | L | D | E* | Q | Lys(C18) | Aib | # | | | | | |
| EU-A569 | 287 | H | Aib | Q | G | T | F | T | S | D | Y | S | K* | Y | L | D | E* | Q | Lys(C20) | Aib | # | | | | | |

FIG. 2 (Continued)
Table 2 (Continued)

| | SEQ. ID. NO. | 1 | | | 5 | | | | | 10 | | | | | 15 | | | | | 20 | | | | 25 |
|---|---|---|---|---|---|---|---|---|---|---|---|---|---|---|---|---|---|---|---|---|---|---|---|---|
| EU-A570 | 288 | H | Aib | Q | G | T | F | T | S | D | Y | S | E* | Y | L | D | K* | R | Lys(C12) | Aib | Aib | # | | |
| EU-A571 | 289 | H | Aib | Q | G | T | F | T | S | D | Y | S | E* | Y | L | D | K* | R | Lys(C14) | Aib | Aib | # | | |
| EU-A572 | 290 | H | Aib | Q | G | T | F | T | S | D | Y | S | E* | Y | L | D | K* | R | Lys(C16) | Aib | Aib | # | | |
| EU-A573 | 291 | H | Aib | Q | G | T | F | T | S | D | Y | S | E* | Y | L | D | K* | R | Lys(C18) | Aib | Aib | # | | |
| EU-A574 | 292 | H | Aib | Q | G | T | F | T | S | D | Y | S | E* | Y | L | D | K* | R | Lys(C20) | Aib | Aib | # | | |
| EU-A575 | 293 | H | Aib | Q | G | T | F | T | S | D | Y | S | E* | Y | L | D | K* | hArg | Lys(C12) | Aib | Aib | # | | |
| EU-A576 | 294 | H | Aib | Q | G | T | F | T | S | D | Y | S | E* | Y | L | D | K* | hArg | Lys(C14) | Aib | Aib | # | | |
| EU-A577 | 295 | H | Aib | Q | G | T | F | T | S | D | Y | S | E* | Y | L | D | K* | hArg | Lys(C16) | Aib | Aib | # | | |
| EU-A578 | 296 | H | Aib | Q | G | T | F | T | S | D | Y | S | E* | Y | L | D | K* | hArg | Lys(C18) | Aib | Aib | # | | |
| EU-A579 | 297 | H | Aib | Q | G | T | F | T | S | D | Y | S | E* | Y | L | D | K* | hArg | Lys(C20) | Aib | Aib | # | | |
| EU-A580 | 298 | H | Ac4c | Q | G | T | F | T | S | D | Y | S | K* | Y | L | D | E* | R | Lys(C12) | Aib | Aib | # | | |
| EU-A581 | 299 | H | Ac4c | Q | G | T | F | T | S | D | Y | S | K* | Y | L | D | E* | R | Lys(C14) | Aib | Aib | # | | |
| EU-A582 | 300 | H | Ac4c | Q | G | T | F | T | S | D | Y | S | K* | Y | L | D | E* | R | Lys(C16) | Aib | Aib | # | | |
| EU-A583 | 301 | H | Ac4c | Q | G | T | F | T | S | D | Y | S | K* | Y | L | D | E* | R | Lys(C18) | Aib | Aib | # | | |
| EU-A584 | 302 | H | Ac4c | Q | G | T | F | T | S | D | Y | S | K* | Y | L | D | E* | R | Lys(C20) | Aib | Aib | # | | |
| EU-A585 | 303 | H | Ac4c | Q | G | T | F | T | S | D | Y | S | K* | Y | L | D | E* | hArg | Lys(C12) | Aib | Aib | # | | |
| EU-A586 | 304 | H | Ac4c | Q | G | T | F | T | S | D | Y | S | K* | Y | L | D | E* | hArg | Lys(C14) | Aib | Aib | # | | |
| EU-A587 | 305 | H | Ac4c | Q | G | T | F | T | S | D | Y | S | K* | Y | L | D | E* | hArg | Lys(C16) | Aib | Aib | # | | |
| EU-A588 | 306 | H | Ac4c | Q | G | T | F | T | S | D | Y | S | K* | Y | L | D | E* | hArg | Lys(C18) | Aib | Aib | # | | |
| EU-A589 | 307 | H | Ac4c | Q | G | T | F | T | S | D | Y | S | K* | Y | L | D | E* | hArg | Lys(C20) | Aib | Aib | # | | |
| EU-A590 | 308 | H | Ac4c | Q | G | T | F | T | S | D | Y | S | E* | Y | L | D | K* | R | Lys(C12) | Aib | Aib | # | | |
| EU-A591 | 309 | H | Ac4c | Q | G | T | F | T | S | D | Y | S | E* | Y | L | D | K* | R | Lys(C14) | Aib | Aib | # | | |
| EU-A592 | 310 | H | Ac4c | Q | G | T | F | T | S | D | Y | S | E* | Y | L | D | K* | R | Lys(C16) | Aib | Aib | # | | |
| EU-A593 | 311 | H | Ac4c | Q | G | T | F | T | S | D | Y | S | E* | Y | L | D | K* | R | Lys(C18) | Aib | Aib | # | | |
| EU-A594 | 312 | H | Ac4c | Q | G | T | F | T | S | D | Y | S | E* | Y | L | D | K* | R | Lys(C20) | Aib | Aib | # | | |
| EU-A595 | 313 | H | Ac4c | Q | G | T | F | T | S | D | Y | S | E* | Y | L | D | K* | hArg | Lys(C12) | Aib | Aib | # | | |
| EU-A596 | 314 | H | Ac4c | Q | G | T | F | T | S | D | Y | S | E* | Y | L | D | K* | hArg | Lys(C14) | Aib | Aib | # | | |
| EU-A597 | 315 | H | Ac4c | Q | G | T | F | T | S | D | Y | S | E* | Y | L | D | K* | hArg | Lys(C16) | Aib | Aib | # | | |
| EU-A598 | 316 | H | Ac4c | Q | G | T | F | T | S | D | Y | S | E* | Y | L | D | K* | hArg | Lys(C18) | Aib | Aib | # | | |
| EU-A599 | 317 | H | Ac4c | Q | G | T | F | T | S | D | Y | S | E* | Y | L | D | K* | hArg | Lys(C20) | Aib | Aib | # | | |

MeF means C-alphaMe-Phe.
Lys(C12) means N-epsilon-(1'-dodecyl beta-D-glucuronyl)-L-lysine and other C numbers mean the corresponding 1'-alkyl glucoronide. The pair of amino acids E*, K* or K*, E* separated by 4 residues denotes a side chain lactam linkage formed between the side chain functional groups on these amino acids.
# means amide C-terminus.

FIG. 3
Table 3

| SEQ. ID. NO. | | 1 | | | | 5 | | | | | 10 | | | | | 15 | | | | | 20 | | | | 25 | | | | | 30 |
|---|---|---|---|---|---|---|---|---|---|---|---|---|---|---|---|---|---|---|---|---|---|---|---|---|---|---|---|---|---|
| EU-A700 | 318 | H | Aib | Q | G | T | F | T | S | D | Y | S | K | Y | L | D | Aib | R | Lys(C12) | Aib | | | | | | | | | |
| EU-A701 | 319 | H | Aib | Q | G | T | F | T | S | D | Y | S | K | Y | L | D | Aib | R | Lys(C14) | Aib | # | | | | | | | | |
| EU-A702 | 320 | H | Aib | Q | G | T | F | T | S | D | Y | S | K | Y | L | D | Aib | R | Lys(C16) | Aib | # | | | | | | | | |
| EU-A703 | 321 | H | Aib | Q | G | T | F | T | S | D | Y | S | K | Y | L | D | Aib | R | Lys(C18) | Aib | # | | | | | | | | |
| EU-A704 | 322 | H | Aib | Q | G | T | F | T | S | D | Y | S | K | Y | L | D | Aib | R | Lys(C20) | Aib | # | | | | | | | | |
| EU-A705 | 323 | H | Aib | Q | G | T | F | T | S | D | Y | S | K | Y | L | D | Aib | hArg | Lys(C12) | Aib | # | | | | | | | | |
| EU-A706 | 324 | H | Aib | Q | G | T | F | T | S | D | Y | S | K | Y | L | D | Aib | hArg | Lys(C14) | Aib | # | | | | | | | | |
| EU-A707 | 325 | H | Aib | Q | G | T | F | T | S | D | Y | S | K | Y | L | D | Aib | hArg | Lys(C16) | Aib | # | | | | | | | | |
| EU-A708 | 326 | H | Aib | Q | G | T | F | T | S | D | Y | S | K | Y | L | D | Aib | hArg | Lys(C18) | Aib | # | | | | | | | | |
| EU-A709 | 327 | H | Aib | Q | G | T | F | T | S | D | Y | S | K | Y | L | D | Aib | hArg | Lys(C20) | Aib | # | | | | | | | | |
| EU-A710 | 328 | H | Aib | Q | G | T | F | T | S | D | Y | S | K | Y | L | D | Aib | R | Lys(C12) | Aib | | | | | | | | | |
| EU-A711 | 329 | H | Aib | Q | G | T | F | T | S | D | Y | S | K | Y | L | D | Aib | R | Lys(C14) | Aib | # | | | | | | | | |
| EU-A712 | 330 | H | Aib | Q | G | T | F | T | S | D | Y | S | K | Y | L | D | Aib | R | Lys(C16) | Aib | # | | | | | | | | |
| EU-A713 | 331 | H | Aib | Q | G | T | F | T | S | D | Y | S | K | Y | L | D | Aib | R | Lys(C18) | Aib | # | | | | | | | | |
| EU-A714 | 332 | H | Aib | Q | G | T | F | T | S | D | Y | S | K | Y | L | D | Aib | R | Lys(C20) | Aib | # | | | | | | | | |
| EU-A715 | 333 | H | Aib | Q | G | T | F | T | S | D | Y | S | K | Y | L | D | Aib | hArg | Lys(C12) | Aib | | | | | | | | | |
| EU-A716 | 334 | H | Aib | Q | G | T | F | T | S | D | Y | S | K | Y | L | D | Aib | hArg | Lys(C14) | Aib | | | | | | | | | |
| EU-A717 | 335 | H | Aib | Q | G | T | F | T | S | D | Y | S | K | Y | L | D | Aib | hArg | Lys(C16) | Aib | | | | | | | | | |
| EU-A718 | 336 | H | Aib | Q | G | T | F | T | S | D | Y | S | K | Y | L | D | Aib | hArg | Lys(C18) | Aib | | | | | | | | | |
| EU-A719 | 337 | H | Aib | Q | G | T | F | T | S | D | Y | S | K | Y | L | D | Aib | hArg | Lys(C20) | Aib | | | | | | | | | |
| EU-A720 | 338 | H | Ac3c | Q | G | T | F | T | S | D | Y | S | K | Y | L | D | Aib | hArg | Lys(C12) | Aib | | | | | | | | | |
| EU-A721 | 339 | H | Aib | Q | G | T | F | T | S | D | Y | S | K | Y | L | D | S | Arg | Lys(C12) | # | | | | | | | | | |
| EU-A722 | 340 | H | Aib | Q | G | T | F | T | S | D | Y | S | K | Y | L | D | S | hArg | Lys(C12) | # | | | | | | | | | |
| EU-A723 | 341 | H | Aib | Q | G | T | F | T | S | D | Y | S | K | Y | L | D | Aib | Arg | Lys(C12) | # | | | | | | | | | |
| EU-A724 | 342 | H | Aib | Q | G | T | F | T | S | D | Y | S | K | Y | L | D | Aib | hArg | Lys(C12) | # | | | | | | | | | |
| EU-A725 | 343 | H | Ac4c | Q | G | T | F | T | S | D | Y | S | K | Y | L | D | Aib | Arg | Lys(C12) | # | | | | | | | | | |
| EU-A726 | 344 | H | Ac4c | Q | G | T | F | T | S | D | Y | S | K | Y | L | D | Aib | hArg | Lys(C12) | # | | | | | | | | | |
| EU-A727 | 345 | H | Ac4c | Q | G | T | F | T | S | D | Y | S | K | Y | L | D | Aib | Arg | Lys(C14) | # | | | | | | | | | |
| EU-A728 | 346 | H | Ac4c | Q | G | T | F | T | S | D | Y | S | K | Y | L | D | Aib | hArg | Lys(C16) | # | | | | | | | | | |
| EU-A729 | 347 | H | Ac4c | Q | G | T | F | T | S | D | Y | S | K | Y | L | D | Aib | hArg | Lys(C18) | # | | | | | | | | | |
| EU-A730 | 348 | H | Ac4c | Q | G | T | F | T | S | D | Y | S | K* | L | D | Aib | Arg | Lys(C12) | # | | | | | | | | | | |
| EU-A731 | 349 | H | Aib | Q | G | T | F | T | S | D | E* | S | K | Y | K* | D | S | Arg | Lys(C14) | # | | | | | | | | | |
| EU-A732 | 350 | H | Ac4c | Q | G | T | F | T | S | D | E* | S | K | Y | K* | D | Aib | hArg | Lys(C14) | # | | | | | | | | | |

FIG. 3 (Continued)
Table 3 (Continued)

| SEQ ID | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A733 | 351 | H | Aib | Q | G | T | F | T | S | D | Y | S | K | E* | L | D | S | K* | Lys(C12) | # | | | | | | | | | | | |
| EU-A734 | 352 | H | Aib | Q | G | T | F | T | S | D | Y | S | K | Y | L | D | S | E* | Lys(C12) | A | K* | # | | | | | | | | | |
| EU-A735 | 353 | H | Aib | Q | G | T | F | T | S | D | Y | S | K | Y | L | D | S | E* | Lys(C12) | A | R | K*# | | | | | | | | | |
| EU-A736 | 354 | H | Aib | Q | G | T | F | T | S | D | Y | S | K | Y | L | D | S | E* | Lys(C14) | A | R | K*# | | | | | | | | | |
| EU-A737 | 355 | H | Aib | Q | G | T | F | T | S | D | Y | S | K | Y | L | D | S | E* | Lys(C16) | A | R | K*# | | | | | | | | | |
| EU-A738 | 356 | H | Aib | Q | G | T | F | T | S | D | Y | S | K | Y | L | D | S | E* | Lys(C18) | A | R | K*# | | | | | | | | | |
| EU-A739 | 357 | H | Aib | Q | G | T | F | T | S | D | Y | S | K | Y | L | D | S | E* | Lys(C20) | A | R | K*# | | | | | | | | | |
| EU-A740 | 358 | H | Aib | Q | G | T | F | T | S | D | Y | S | K | Y | L | D | S | E* | Lys(C12) | A | Q | K*# | | | | | | | | | |
| EU-A741 | 359 | H | Aib | Q | G | T | F | T | S | D | Y | S | K | Y | L | D | S | E* | Lys(C14) | A | Q | K*# | | | | | | | | | |
| EU-A742 | 360 | H | Aib | Q | G | T | F | T | S | D | Y | S | K | Y | L | D | S | E* | Lys(C16) | A | Q | K*# | | | | | | | | | |
| EU-A743 | 361 | H | Aib | Q | G | T | F | T | S | D | Y | S | K | Y | L | D | S | E* | Lys(C18) | A | Q | K*# | | | | | | | | | |
| EU-A744 | 362 | H | Aib | Q | G | T | F | T | S | D | Y | S | K | Y | L | D | S | E* | Lys(C20) | A | Q | K*# | | | | | | | | | |
| EU-A745 | 363 | H | Aib | Q | G | T | F | T | S | D | Y | S | K | Y | L | D | S | E* | Lys(C12) | V | R | K*# | | | | | | | | | |
| EU-A746 | 364 | H | Aib | Q | G | T | aMeF | T | S | D | Y | Lys(C8) | # | | | | | | | | | | | | | | | | | | |
| EU-A747 | 365 | H | Aib | Q | G | T | aMeF | T | S | D | Y | Lys(C14) | # | | | | | | | | | | | | | | | | | | |
| EU-A748 | 366 | H | Aib | Q | G | T | aMeF | T | S | D | Y | Lys(C16) | # | | | | | | | | | | | | | | | | | | |
| EU-A749 | 367 | H | Aib | Q | G | T | aMeF | T | S | D | Y | Lys(C20) | # | | | | | | | | | | | | | | | | | | |
| EU-A750 | 368 | H | Aib | Q | G | T | F | T | S | D | Y | Lys(C12) | # | | | | | | | | | | | | | | | | | | |
| EU-A751 | 369 | H | Aib | Q | G | T | aMeF | T | S | D | Y | Lys(C12) | # | | | | | | | | | | | | | | | | | | |
| EU-A752 | 370 | H | Aib | Q | G | T | aMeF | T | S | D | Y | Lys(C18) | # | | | | | | | | | | | | | | | | | | |
| EU-A753 | 371 | H | aMePro | Q | G | T | aMeF | T | S | D | Y | Lys(C12) | # | | | | | | | | | | | | | | | | | | |
| EU-A754 | 372 | H | aMePro | Q | G | T | aMeF | T | S | D | Y | Lys(C18) | # | | | | | | | | | | | | | | | | | | |
| EU-A755 | 373 | H | aMePro | Q | G | T | aMeF | T | S | D | Bip | Lys(C12) | # | | | | | | | | | | | | | | | | | | |
| EU-A756 | 374 | H | Aib | Q | G | T | F | T | S | D | Bip | Lys(C8) | # | | | | | | | | | | | | | | | | | | |
| EU-A757 | 375 | H | Aib | Q | G | T | F | T | S | D | Bip | Lys(C18) | # | | | | | | | | | | | | | | | | | | |
| EU-A758 | 376 | H | Aib | Q | G | T | aMeF | T | S | D | Y | Lys(C8) | # | | | | | | | | | | | | | | | | | | |
| EU-A759 | 377 | H | aMePro | Q | G | T | aMeF | T | S | D | Y | Lys(16) | # | | | | | | | | | | | | | | | | | | |
| EU-A760 | 378 | H | G | Q | G | T | F | T | S | D | Y | S | K | Y | L | D | E | Lys(C8) | A | R | E | F | I | A | W | L | N | T | # | | |
| EU-A761 | 379 | H | G | Q | G | T | F | T | S | D | Y | S | K | Y | L | D | E | Lys(C12) | A | R | E | F | I | A | W | L | N | T | # | | |
| EU-A762 | 380 | H | G | Q | G | T | F | T | S | D | Y | S | K | Y | L | D | E | Lys(C14) | A | R | E | F | I | A | W | L | N | T | # | | |
| EU-A763 | 381 | H | G | Q | G | T | F | T | S | D | Y | S | K | Y | L | D | E | Lys(C16) | A | R | E | F | I | A | W | L | N | T | # | | |
| EU-A764 | 382 | H | G | Q | G | T | F | T | S | D | Y | S | K | Y | L | D | E | Lys(C18) | A | R | E | F | I | A | W | L | N | T | # | | |
| EU-A765 | 383 | H | G | Q | G | T | F | T | S | D | Y | S | K | Y | L | D | E | Lys(C20) | A | R | E | F | I | A | W | L | N | T | # | | |
| EU-A766 | 384 | H | G | Q | G | T | F | T | S | D | Y | S | K | Y | L | D | E | Lys(C8) | A | K | E | F | I | A | W | L | N | T | # | | |
| EU-A767 | 385 | H | G | Q | G | T | F | T | S | D | Y | S | K | Y | L | D | E | Lys(C14) | A | K | E | F | I | A | W | L | N | T | # | | |

FIG. 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A768 | 386 | H | G | Q | G | T | F | T | S | D | Y | S | K | Y | L | D | E | Lys(C16) | A | A | K | E | F | I | A | W | L | N | T | # |
| EU-A769 | 387 | H | G | Q | G | T | F | T | S | D | Y | S | K | Y | L | D | E | Lys(C20) | A | A | K | E | F | I | A | W | L | N | T | # |
| EU-A770 | 388 | H | G | Q | G | T | F | T | S | D | Y | S | K | Y | L | D | E | K | A | A | K | E | F | I | A | W | L | N | T | # |
| EU-A771 | 389 | H | G | Q | G | T | F | T | S | D | Y | S | K | Y | L | D | E | Lys(C12) | A | A | K | E | F | I | A | W | L | N | T | # |
| EU-A772 | 390 | H | G | Q | G | T | F | T | S | D | Y | S | K | Y | L | D | E | Lys(C18) | A | A | K | E | F | I | A | W | L | N | T | # |
| EU-A773 | 391 | H | Aib | Q | G | T | F | T | S | D | Y | S | K | Y | L | D | E | Lys(C18) | A | A | K | E | F | I | A | W | L | N | T | # |
| EU-A774 | 392 | H | G | Q | G | T | F | T | S | D | Y | S | K | Y | L | D | E | R | R | A | K | D | F | V | Q | W | L | N | T | # |
| EU-A775 | 393 | H | G | Q | G | T | F | T | S | D | Y | S | K | Y | L | D | E | R | R | A | Lys(C12) | D | F | V | Q | W | L | N | T | # |
| EU-A776 | 394 | H | G | Q | G | T | F | T | S | D | Y | S | K | Y | L | D | E | R | R | A | Lys(C18) | D | F | V | Q | W | L | N | T | # |
| EU-A777 | 395 | H | Aib | Q | G | T | F | T | S | D | Y | S | K | Y | L | D | E | R | R | A | Lys(C18) | D | F | V | Q | W | L | N | T | # |
| EU-A778 | 396 | H | Aib | Q | G | T | F | T | S | D | Y | S | K | Y | L | D | E | Lys(C12) | R | A | Lys(C8) | D | F | V | Q | W | L | N | T | # |
| EU-A779 | 397 | H | Aib | Q | G | T | F | T | S | D | Y | S | K | Y | L | D | E | Lys(C18) | R | A | Lys(C12) | D | F | V | Q | W | L | N | T | # |
| EU-A780 | 398 | H | Aib | Q | G | T | F | T | S | D | Y | S | K | Y | L | D | E | Lys(C18) | R | A | Lys(C14) | D | F | V | Q | W | L | N | T | # |
| EU-A781 | 399 | H | Aib | Q | G | T | F | T | S | D | Y | S | K | Y | L | D | E | R | R | A | Lys(C16) | D | F | V | Q | W | L | N | T | # |
| EU-A782 | 400 | H | Aib | Q | G | T | F | T | S | D | Y | S | K | Y | L | D | E | R | R | A | Lys(C18) | D | F | V | Q | W | L | N | T | # |
| EU-A783 | 401 | H | Aib | Q | G | T | F | T | S | D | Y | S | K | Y | L | D | E | R | R | A | Lys(C20) | D | F | V | Q | W | L | N | T | # |
| EU-A784 | 402 | H | G | Q | G | T | F | T | S | D | Y | S | K | Y | L | D | E | R | R | A | Lys(C8) | D | F | V | Q | W | L | N | T | # |
| EU-A785 | 403 | H | G | Q | G | T | F | T | S | D | Y | S | K | Y | L | D | E | R | R | A | Lys(C12) | D | F | V | Q | W | L | N | T | # |
| EU-A786 | 404 | H | G | Q | G | T | F | T | S | D | Y | S | K | Y | L | D | E | R | R | A | Lys(C14) | D | F | V | Q | W | L | N | T | # |
| EU-A787 | 405 | H | G | Q | G | T | F | T | S | D | Y | S | K | Y | L | D | E | R | R | A | Lys(C16) | D | F | V | Q | W | L | N | T | # |
| EU-A788 | 406 | H | Aib | Q | G | T | F | T | S | D | Y | S | K | Y | L | D | E | R | R | A | Lys(C18) | D | F | V | Q | W | L | N | T | # |
| EU-A789 | 407 | H | Aib | Q | G | T | F | T | S | D | Y | S | K | Y | L | D | E | R | R | A | Lys(C20) | D | F | V | Q | W | L | N | T | # |
| EU-A790 | 408 | H | Aib | Q | G | T | F | T | S | D | Y | S | K | Y | L | D | E | Lys(C8) | A | A | K | E | F | I | A | W | L | N | T | # |
| EU-A791 | 409 | H | Aib | Q | G | T | F | T | S | D | Y | S | K | Y | L | D | E | Lys(C12) | A | A | K | E | F | I | A | W | L | N | T | # |
| EU-A792 | 410 | H | Aib | Q | G | T | F | T | S | D | Y | S | K | Y | L | D | E | Lys(C14) | A | A | K | E | F | I | A | W | L | N | T | # |
| EU-A793 | 411 | H | Aib | Q | G | T | F | T | S | D | Y | S | K | Y | L | D | E | Lys(C16) | A | A | K | E | F | I | A | W | L | N | T | # |
| EU-A794 | 412 | H | Aib | Q | G | T | F | T | S | D | Y | S | K | Y | L | D | E | Lys(C18) | A | A | K | E | F | I | A | W | L | N | T | # |
| EU-A795 | 413 | H | Aib | Q | G | T | F | T | S | D | Y | S | K | Y | L | D | E | Lys(C20) | A | A | K | E | F | I | A | W | L | N | T | # |
| EU-A796 | 414 | H | Aib | Q | G | T | F | T | S | D | Y | S | K | Y | L | D | E* | Q | A | A | K* | E | F | I | A | W | L | N | T | # |
| EU-A797 | 415 | H | Aib | Q | G | T | F | T | S | D | Y | S | K | Y | L | D | E* | Q | A | A | K* | E | F | I | A | W | L | N | T | # |
| EU-A798 | 416 | H | Aib | Q | G | T | F | T | S | D | Y | S | K | Y | L | D | E* | Q | A | A | K* | E | F | I | A | W | L | N | T | # |
| EU-A799 | 417 | H | Aib | Q | G | T | F | T | S | D | Y | S | K | Y | L | D | E* | Q | A | A | K* | E | F | I | A | W | L | N | T | # |
| EU-A800 | 418 | H | Aib | Q | G | T | F | T | S | D | Y | S | K | Y | L | D | E* | Q | A | A | K* | E | F | I | A | Lys(C8) | M | L | N | T | # |
| EU-A801 | 419 | H | Aib | Q | G | T | F | T | S | D | Y | S | K | Y | L | D | E* | Q | A | A | K* | E | F | I | A | Lys(C12) | M | L | N | T | # |
| | | | | | | | | | | | | | | | | | | | | | | | | | | Lys(C14) | M | | | | |
| | | | | | | | | | | | | | | | | | | | | | | | | | | Lys(C16) | M | | | | |
| | | | | | | | | | | | | | | | | | | | | | | | | | | Lys(C18) | M | | | | |
| | | | | | | | | | | | | | | | | | | | | | | | | | | Lys(C20) | M | | | | |
| EU-A802 | 420 | H | Aib | Q | G | T | F | T | S | D | Y | S | K | Y | L | D | E* | Q | A | A | K* | E | F | I | A | Lys(C8) | L | N | T | # | |

FIG. 3 (Continued)
Table 3 (Continued)

| | SEQ. ID. NO. | 1 | | | | 5 | | | | | 10 | | | | 15 | | | | | 20 | | | | | | 25 | | | | | 30 |
|---|---|---|---|---|---|---|---|---|---|---|---|---|---|---|---|---|---|---|---|---|---|---|---|---|---|---|---|---|---|---|---|
| EU-A803 | 421 | H | Aib | Q | G | T | F | T | S | D | Y | S | K | Y | L | D | E* | | Q | | A | K* | E | F | | Lys(C12) | W | L | N | T | # |
| EU-A804 | 422 | H | Aib | Q | G | T | F | T | S | D | Y | S | K | Y | L | D | E* | | Q | | A | K* | E | F | | Lys(C14) | W | L | N | T | # |
| EU-A805 | 423 | H | Aib | Q | G | T | F | T | S | D | Y | S | K | Y | L | D | E* | | Q | | A | K* | E | F | | Lys(C16) | W | L | N | T | # |
| EU-A806 | 424 | H | Aib | Q | G | T | F | T | S | D | Y | S | K | Y | L | D | E* | | Q | | A | K* | E | F | | Lys(C18) | W | L | N | T | # |
| EU-A807 | 425 | H | Aib | Q | G | T | F | T | S | D | Y | S | K | Y | L | D | E* | | Q | | A | K* | E | F | | Lys(C20) | W | L | N | T | # |
| EU-A808 | 426 | H | G | Q | G | T | F | T | S | D | Y | S | K | Y | L | D | E | | Q | | A | R | E | F | | Lys(C8) | W | L | N | T | # |
| EU-A809 | 427 | H | G | Q | G | T | F | T | S | D | Y | S | K | Y | L | D | E | | Q | | A | R | E | F | | Lys(C12) | W | L | N | T | # |
| EU-A810 | 428 | H | G | Q | G | T | F | T | S | D | Y | S | K | Y | L | D | E | | Q | | A | R | E | F | | Lys(C14) | W | L | N | T | # |
| EU-A811 | 429 | H | G | Q | G | T | F | T | S | D | Y | S | K | Y | L | D | E | | Q | | A | R | E | F | | Lys(C16) | W | L | N | T | # |
| EU-A812 | 430 | H | G | Q | G | T | F | T | S | D | Y | S | K | Y | L | D | E | | Q | | A | R | E | F | | Lys(C18) | W | L | N | T | # |
| EU-A813 | 431 | H | G | Q | G | T | F | T | S | D | Y | S | K | Y | L | D | E | | Q | | A | R | E | F | | Lys(C20) | W | L | N | T | # |
| EU-A814 | 432 | H | Aib | Q | G | T | F | T | S | D | Y | S | K | Y | L | D | E | Lys(C8) | | A | A | R | E | F | | | W | L | N | T | # |
| EU-A815 | 433 | H | Aib | Q | G | T | F | T | S | D | Y | S | K | Y | L | D | E | Lys(C12) | | A | A | R | E | F | | | W | L | N | T | # |
| EU-A816 | 434 | H | Aib | Q | G | T | F | T | S | D | Y | S | K | Y | L | D | E | Lys(C14) | | A | A | R | E | F | | | W | L | N | T | # |
| EU-A817 | 435 | H | Aib | Q | G | T | F | T | S | D | Y | S | K | Y | L | D | E | Lys(C16) | | A | A | R | E | F | | | W | L | N | T | # |
| EU-A818 | 436 | H | Aib | Q | G | T | F | T | S | D | Y | S | K | Y | L | D | E | Lys(C18) | | A | A | R | E | F | | | W | L | N | T | # |
| EU-A819 | 437 | H | Aib | Q | G | T | F | T | S | D | Y | S | K | Y | L | D | E | Lys(C20) | | A | A | R | E | F | | | W | L | N | T | # |
| EU-A820 | 438 | H | G | Q | G | T | F | T | S | D | Y | S | K | Y | L | D | E | R | | R | A | Q | D | F | V | Lys(C8) | W | L | N | T | # |
| EU-A821 | 439 | H | G | Q | G | T | F | T | S | D | Y | S | K | Y | L | D | E | R | | R | A | Q | D | F | V | Lys(C12) | W | L | N | T | # |
| EU-A822 | 440 | H | G | Q | G | T | F | T | S | D | Y | S | K | Y | L | D | E | R | | R | A | Q | D | F | V | Lys(C14) | W | L | N | T | # |
| EU-A823 | 441 | H | G | Q | G | T | F | T | S | D | Y | S | K | Y | L | D | E | R | | R | A | Q | D | F | V | Lys(C16) | W | L | N | T | # |
| EU-A824 | 442 | H | G | Q | G | T | F | T | S | D | Y | S | K | Y | L | D | E | R | | R | A | Q | D | F | V | Lys(C18) | W | L | N | T | # |
| EU-A825 | 443 | H | G | Q | G | T | F | T | S | D | Y | S | K | Y | L | D | E | R | | R | A | Q | D | F | V | Lys(C20) | W | L | N | T | # |
| EU-A826 | 444 | H | aMePro | Q | G | T | aMeF | T | S | D | Bip | Lys(C8) | # | | | | | | | | | | | | | | | | | | |
| EU-A827 | 445 | H | aMePro | Q | G | T | aMeF | T | S | D | Bip | Lys(C12) | # | | | | | | | | | | | | | | | | | | |
| EU-A828 | 446 | H | aMePro | Q | G | T | aMeF | T | S | D | Bip | Lys(C14) | # | | | | | | | | | | | | | | | | | | |
| EU-A829 | 447 | H | aMePro | Q | G | T | aMeF | T | S | D | Bip | Lys(C16) | # | | | | | | | | | | | | | | | | | | |
| EU-A830 | 448 | H | aMePro | Q | G | T | aMeF | T | S | D | Bip | Lys(C18) | # | | | | | | | | | | | | | | | | | | |
| EU-A831 | 449 | H | aMePro | Q | G | T | aMeF | T | S | D | Bip | Lys(C20) | # | | | | | | | | | | | | | | | | | | |
| EU-A832 | 450 | H | aMePro | Q | G | T | aMeFF | T | S | D | Bip | Lys(C8) | # | | | | | | | | | | | | | | | | | | |
| EU-A833 | 451 | H | aMePro | Q | G | T | aMeFF | T | S | D | Bip | Lys(C12) | # | | | | | | | | | | | | | | | | | | |
| EU-A834 | 452 | H | aMePro | Q | G | T | aMeFF | T | S | D | Bip | Lys(C14) | # | | | | | | | | | | | | | | | | | | |
| EU-A835 | 453 | H | aMePro | Q | G | T | aMeFF | T | S | D | Bip | Lys(C16) | # | | | | | | | | | | | | | | | | | | |
| EU-A836 | 454 | H | aMePro | Q | G | T | aMeFF | T | S | D | Bip | Lys(C18) | # | | | | | | | | | | | | | | | | | | |
| EU-A837 | 455 | H | aMePro | Q | G | T | aMeFF | T | S | D | Bip | Lys(C20) | # | | | | | | | | | | | | | | | | | | |

FIG. 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A838 | 446 | H | Aib | Q | G | T | αMeF | T | S | D | Bip | Lys(C8) | | | | | | | | | | | | | | | | | | | |
| EU-A839 | 447 | H | Aib | Q | G | T | αMeF | T | S | D | Bip | Lys(C12) | # | | | | | | | | | | | | | | | | | | |
| EU-A840 | 448 | H | Aib | Q | G | T | αMeF | T | S | D | Bip | Lys(C14) | # | | | | | | | | | | | | | | | | | | |
| EU-A841 | 449 | H | Aib | Q | G | T | αMeF | T | S | D | Bip | Lys(C16) | # | | | | | | | | | | | | | | | | | | |
| EU-A842 | 450 | H | Aib | Q | G | T | αMeF | T | S | D | Bip | Lys(C20) | # | | | | | | | | | | | | | | | | | | |
| EU-A843 | 451 | H | Aib | Q | G | T | αMeFF | T | S | D | Bip | Lys(C8) | # | | | | | | | | | | | | | | | | | | |
| EU-A844 | 452 | H | Aib | Q | G | T | αMeFF | T | S | D | Bip | Lys(C12) | # | | | | | | | | | | | | | | | | | | |
| EU-A845 | 453 | H | Aib | Q | G | T | αMeFF | T | S | D | Bip | Lys(C14) | # | | | | | | | | | | | | | | | | | | |
| EU-A846 | 454 | H | Aib | Q | G | T | αMeFF | T | S | D | Bip | Lys(C16) | # | | | | | | | | | | | | | | | | | | |
| EU-A847 | 455 | H | Aib | Q | G | T | αMeFF | T | S | D | Bip | Lys(C18) | # | | | | | | | | | | | | | | | | | | |
| EU-A848 | 456 | H | Aib | Q | G | T | αMeFF | T | S | D | Bip | Lys(C20) | # | | | | | | | | | | | | | | | | | | |
| EU-A849 | 457 | H | G | Q | G | T | F | T | S | D | Y | S | K | Y | L | D | A | Lys(C8) | A | A | R | E | F | I | A | W | L | L | N | T | # |
| EU-A850 | 458 | H | G | Q | G | T | F | T | S | D | Y | S | K | Y | L | D | A | Lys(C12) | A | A | R | E | F | I | A | W | L | L | N | T | # |
| EU-A851 | 459 | H | G | Q | G | T | F | T | S | D | Y | S | K | Y | L | D | A | Lys(C14) | A | A | R | E | F | I | A | W | L | L | N | T | # |
| EU-A852 | 460 | H | G | Q | G | T | F | T | S | D | Y | S | K | Y | L | D | A | Lys(C16) | A | A | R | E | F | I | A | W | L | L | N | T | # |
| EU-A853 | 461 | H | G | Q | G | T | F | T | S | D | Y | S | K | Y | L | D | A | Lys(C18) | A | A | R | E | F | I | A | W | L | L | N | T | # |
| EU-A854 | 462 | H | G | Q | G | T | F | T | S | D | Y | S | K | Y | L | D | A | Lys(C20) | A | A | K | E | F | I | A | W | L | L | N | T | # |
| EU-A855 | 463 | H | G | Q | G | T | F | T | S | D | Y | S | K | Y | L | D | A | Lys(C8) | A | A | K | E | F | I | A | W | L | L | N | T | # |
| EU-A856 | 464 | H | G | Q | G | T | F | T | S | D | Y | S | K | Y | L | D | A | Lys(C12) | A | A | K | E | F | I | A | W | L | L | N | T | # |
| EU-A857 | 465 | H | G | Q | G | T | F | T | S | D | Y | S | K | Y | L | D | A | Lys(C14) | A | A | K | E | F | I | A | W | L | L | N | T | # |
| EU-A858 | 466 | H | G | Q | G | T | F | T | S | D | Y | S | K | Y | L | D | A | Lys(C16) | A | A | K | E | F | I | A | W | L | L | N | T | # |
| EU-A859 | 467 | H | G | Q | G | T | F | T | S | D | Y | S | K | Y | L | D | A | Lys(C18) | A | A | K | E | F | I | A | W | L | L | N | T | # |
| EU-A860 | 468 | H | G | Q | G | T | F | T | S | D | Y | S | K | Y | L | D | A | Lys(C20) | A | A | K | E | F | I | A | W | L | L | N | T | # |
| EU-A861 | 469 | H | G | Q | G | T | F | T | S | D | Y | S | K | Y | L | D | Aib | Lys(C8) | A | A | K | E | F | I | A | W | L | L | N | T | # |
| EU-A862 | 470 | H | G | Q | G | T | F | T | S | D | Y | S | K | Y | L | D | Aib | Lys(C12) | A | A | K | E | F | I | A | W | L | L | N | T | # |
| EU-A863 | 471 | H | G | Q | G | T | F | T | S | D | Y | S | K | Y | L | D | Aib | Lys(C14) | A | A | K | E | F | I | A | W | L | L | N | T | # |
| EU-A864 | 472 | H | G | Q | G | T | F | T | S | D | Y | S | K | Y | L | D | Aib | Lys(C16) | A | A | K | E | F | I | A | W | L | L | N | T | # |
| EU-A865 | 473 | H | G | Q | G | T | F | T | S | D | Y | S | K | Y | L | D | Aib | Lys(C18) | A | A | K | E | F | I | A | W | L | L | N | T | # |
| EU-A866 | 474 | H | G | Q | G | T | F | T | S | D | Y | S | K | Y | L | D | Aib | Lys(C20) | A | A | K | E | F | I | A | W | L | L | N | T | # |
| EU-A867 | 475 | H | G | Q | G | T | F | T | S | D | Y | S | K | Y | L | D | Aib | Lys(C8) | A | A | R | E | F | I | A | W | L | L | N | T | # |
| EU-A868 | 476 | H | G | Q | G | T | F | T | S | D | Y | S | K | Y | L | D | Aib | Lys(C12) | A | A | R | E | F | I | A | W | L | L | N | T | # |
| EU-A869 | 477 | H | G | Q | G | T | F | T | S | D | Y | S | K | Y | L | D | Aib | Lys(C14) | A | A | R | E | F | I | A | W | L | L | N | T | # |
| EU-A870 | 478 | H | G | Q | G | T | F | T | S | D | Y | S | K | Y | L | D | Aib | Lys(C16) | A | A | R | E | F | I | A | W | L | L | N | T | # |
| EU-A871 | 479 | H | G | Q | G | T | F | T | S | D | Y | S | K | Y | L | D | Aib | Lys(C18) | A | A | R | E | F | I | A | W | L | L | N | T | # |
| EU-A872 | 480 | H | G | Q | G | T | F | T | S | D | Y | S | K | Y | L | D | Aib | Lys(C20) | A | A | R | E | F | I | A | W | L | L | N | T | # |

FIG. 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A873 | 481 | H | Aib | Q | G | T | F | T | S | D | Y | S | K | Y | L | D | A | Lys(C8) | A | A | K | E | F | - | A | W | L | L | N | T | # |
| EU-A874 | 482 | H | Aib | Q | G | T | F | T | S | D | Y | S | K | Y | L | D | A | Lys(C12) | A | A | K | E | F | - | A | W | L | L | N | T | # |
| EU-A875 | 483 | H | Aib | Q | G | T | F | T | S | D | Y | S | K | Y | L | D | A | Lys(C14) | A | A | K | E | F | - | A | W | L | L | N | T | # |
| EU-A876 | 484 | H | Aib | Q | G | T | F | T | S | D | Y | S | K | Y | L | D | A | Lys(C16) | A | A | K | E | F | - | A | W | L | L | N | T | # |
| EU-A877 | 485 | H | Aib | Q | G | T | F | T | S | D | Y | S | K | Y | L | D | A | Lys(C18) | A | A | K | E | F | - | A | W | L | L | N | T | # |
| EU-A878 | 486 | H | Aib | Q | G | T | F | T | S | D | Y | S | K | Y | L | D | A | Lys(C20) | A | A | K | E | F | - | A | W | L | L | N | T | # |
| EU-A879 | 487 | H | Aib | Q | G | T | F | T | S | D | Y | S | K | Y | L | D | A | Lys(C8) | A | A | R | E | F | - | A | W | L | L | N | T | # |
| EU-A880 | 488 | H | Aib | Q | G | T | F | T | S | D | Y | S | K | Y | L | D | A | Lys(C12) | A | A | R | E | F | - | A | W | L | L | N | T | # |
| EU-A881 | 489 | H | Aib | Q | G | T | F | T | S | D | Y | S | K | Y | L | D | A | Lys(C14) | A | A | R | E | F | - | A | W | L | L | N | T | # |
| EU-A882 | 490 | H | Aib | Q | G | T | F | T | S | D | Y | S | K | Y | L | D | A | Lys(C16) | A | A | R | E | F | - | A | W | L | L | N | T | # |
| EU-A883 | 491 | H | Aib | Q | G | T | F | T | S | D | Y | S | K | Y | L | D | A | Lys(C18) | A | A | R | E | F | - | A | W | L | L | N | T | # |
| EU-A884 | 492 | H | Aib | Q | G | T | F | T | S | D | Y | S | K | Y | L | D | A | Lys(C20) | A | A | R | E | F | - | A | W | L | L | N | T | # |
| EU-A885 | 493 | H | G | Q | G | T | F | T | S | D | Y | S | K | Y | L | D | A | Q | A | A | R | E | F | - | A | W | L | L | N | T | # |
| EU-A886 | 494 | H | G | Q | G | T | F | T | S | D | Y | S | K | Y | L | D | A | Q | A | A | R | E | F | - | A | W | L | L | N | T | # |
| EU-A887 | 495 | H | G | Q | G | T | F | T | S | D | Y | S | K | Y | L | D | A | Q | A | A | R | E | F | - | A | W | L | L | N | T | # |
| EU-A888 | 496 | H | G | Q | G | T | F | T | S | D | Y | S | K | Y | L | D | A | Q | A | A | R | E | F | - | A | W | L | L | N | T | # |
| EU-A889 | 497 | H | G | Q | G | T | F | T | S | D | Y | S | K | Y | L | D | A | Q | A | A | R | E | F | - | A | W | L | L | N | T | # |
| EU-A890 | 498 | H | G | Q | G | T | F | T | S | D | Y | S | K | Y | L | D | A | Q | A | A | R | E | F | - | A | W | L | L | N | T | # |
| EU-A891 | 499 | H | G | Q | G | T | F | T | S | D | Y | S | K | Y | L | D | A | R | R | A | Lys(C8) | D | F | V | R | W | L | L | N | T | # |
| EU-A892 | 500 | H | G | Q | G | T | F | T | S | D | Y | S | K | Y | L | D | A | R | R | A | Lys(C12) | D | F | V | R | W | L | L | N | T | # |
| EU-A893 | 501 | H | G | Q | G | T | F | T | S | D | Y | S | K | Y | L | D | A | R | R | A | Lys(C14) | D | F | V | R | W | L | L | N | T | # |
| EU-A894 | 502 | H | G | Q | G | T | F | T | S | D | Y | S | K | Y | L | D | A | R | R | A | Lys(C16) | D | F | V | R | W | L | L | N | T | # |
| EU-A895 | 503 | H | G | Q | G | T | F | T | S | D | Y | S | K | Y | L | D | A | R | R | A | Lys(C18) | D | F | V | R | W | L | L | N | T | # |
| EU-A896 | 504 | H | G | Q | G | T | F | T | S | D | Y | S | K | Y | L | D | A | R | R | A | Lys(C20) | D | F | V | R | W | L | L | N | T | # |
| EU-A897 | 505 | H | G | Q | G | T | F | T | S | D | Y | S | K | Y | L | D | A | R | R | A | Lys(C8) | D | F | V | R | W | L | L | N | T | # |
| EU-A898 | 506 | H | G | Q | G | T | F | T | S | D | Y | S | K | Y | L | D | A | R | R | A | Lys(C12) | D | F | V | R | W | L | L | N | T | # |
| EU-A899 | 507 | H | Aib | Q | G | T | F | T | S | D | Y | S | K | Y | L | D | A | R | R | A | Lys(C14) | D | F | V | R | W | L | L | N | T | # |
| EU-A900 | 508 | H | Aib | Q | G | T | F | T | S | D | Y | S | K | Y | L | D | A | R | R | A | Lys(C16) | D | F | V | R | W | L | L | N | T | # |
| EU-A901 | 509 | H | Aib | Q | G | T | F | T | S | D | Y | S | K | Y | L | D | A | R | R | A | Lys(C18) | D | F | V | R | W | L | L | N | T | # |
| EU-A902 | 510 | H | Aib | Q | G | T | F | T | S | D | Y | S | K | Y | L | D | A | R | R | A | Lys(C20) | D | F | V | R | W | L | L | N | T | # |
| EU-A903 | 511 | H | G | Q | G | T | F | T | S | D | Y | S | K | Y | L | D | A | R | R | A | Q | D | F | V | R | W | L | L | N | T | # |
| EU-A904 | 512 | H | G | Q | G | T | F | T | S | D | Y | S | K | Y | L | D | A | R | R | A | Q | D | F | V | R | W | L | L | N | T | # |
| EU-A905 | 513 | H | G | Q | G | T | F | T | S | D | Y | S | K | Y | L | D | A | R | R | A | Q | D | F | V | R | W | L | L | N | T | # |
| EU-A906 | 514 | H | G | Q | G | T | F | T | S | D | Y | S | K | Y | L | D | A | R | R | A | Q | D | F | V | R | W | L | L | N | T | # |
| EU-A907 | 515 | H | G | Q | G | T | F | T | S | D | Y | S | K | Y | L | D | A | R | R | A | Q | D | F | V | R | W | L | L | N | T | # |

FIG. 3 (Continued)
Table 3 (Continued)

| | SEQ ID NO | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 |
|---|---|---|---|---|---|---|---|---|---|---|---|---|---|---|---|---|---|---|---|---|---|---|---|---|---|---|---|---|---|---|---|
| EU-A908 | 516 | H | Aib | Q | G | T | F | T | S | D | Y | S | K | Y | L | D | Aib | Lys(C18) | A | A | K | E | F | - | A | W | L | L | N | T | # |
| EU-A909 | 517 | H | Aib | Q | G | T | F | T | S | D | Y | S | K | Y | L | D | Aib | Lys(C8)  | A | A | K | E | F | - | A | W | L | L | N | T | # |
| EU-A910 | 518 | H | Aib | Q | G | T | F | T | S | D | Y | S | K | Y | L | D | Aib | Lys(C12) | A | A | K | E | F | - | A | W | L | L | N | T | # |
| EU-A911 | 519 | H | Aib | Q | G | T | F | T | S | D | Y | S | K | Y | L | D | Aib | Lys(C14) | A | A | K | E | F | - | A | W | L | L | N | T | # |
| EU-A912 | 520 | H | Aib | Q | G | T | F | T | S | D | Y | S | K | Y | L | D | Aib | Lys(C16) | A | A | K | E | F | - | A | W | L | L | N | T | # |
| EU-A913 | 521 | H | Aib | Q | G | T | F | T | S | D | Y | S | K | Y | L | D | Aib | Lys(C18) | A | A | K | E | F | - | A | W | L | L | N | T | # |
| EU-A914 | 522 | H | Aib | Q | G | T | F | T | S | D | Y | S | K | Y | L | D | Aib | Lys(C20) | A | A | K | E | F | - | A | W | L | L | N | T | # |
| EU-A915 | 523 | H | Aib | Q | G | T | F | T | S | D | Y | S | K | Y | L | D | Aib | Lys(C8)  | A | A | R | E | F | - | A | W | L | L | N | T | # |
| EU-A916 | 524 | H | Aib | Q | G | T | F | T | S | D | Y | S | K | Y | L | D | Aib | Lys(C12) | A | A | R | E | F | - | A | W | L | L | N | T | # |
| EU-A917 | 525 | H | Aib | Q | G | T | F | T | S | D | Y | S | K | Y | L | D | Aib | Lys(C14) | A | A | R | E | F | - | A | W | L | L | N | T | # |
| EU-A918 | 526 | H | Aib | Q | G | T | F | T | S | D | Y | S | K | Y | L | D | Aib | Lys(C16) | A | A | R | E | F | - | A | W | L | L | N | T | # |
| EU-A919 | 527 | H | Aib | Q | G | T | F | T | S | D | Y | S | K | Y | L | D | Aib | Lys(C18) | A | A | R | E | F | - | A | W | L | L | N | T | # |
| EU-A920 | 528 | H | Aib | Q | G | T | F | T | S | D | Y | S | K | Y | L | D | Aib | Lys(C20) | A | A | R | E | F | - | A | W | L | L | N | T | # |
| EU-A921 | 529 | H | Aib | Q | G | T | F | T | S | D | Y | S | K | Y | L | D | Aib | R | R | A | Lys(C18) | D | F | V | A | W | L | L | N | T | # |
| EU-A922 | 530 | H | Aib | Q | G | T | F | T | S | D | Y | S | K | Y | L | D | Aib | R | R | A | Lys(C8)  | D | F | V | A | W | L | L | N | T | # |
| EU-A923 | 531 | H | Aib | Q | G | T | F | T | S | D | Y | S | K | Y | L | D | Aib | R | R | A | Lys(C14) | D | F | V | A | W | L | L | N | T | # |
| EU-A924 | 532 | H | G | Q | G | T | F | T | S | D | Y | S | K | Y | L | D | Aib | R | R | A | Lys(C16) | D | F | V | A | W | L | L | N | T | # |
| EU-A925 | 533 | H | G | Q | G | T | F | T | S | D | Y | S | K | Y | L | D | Aib | R | R | A | Lys(C20) | D | F | V | A | W | L | L | N | T | # |
| EU-A926 | 534 | H | G | Q | G | T | F | T | S | D | Y | S | K | Y | L | D | Aib | R | R | A | Lys(C8)  | D | F | V | A | W | L | L | N | T | # |
| EU-A927 | 535 | H | G | Q | G | T | F | T | S | D | Y | S | K | Y | L | D | Aib | R | R | A | Lys(C12) | D | F | V | A | W | L | L | N | T | # |
| EU-A928 | 536 | H | G | Q | G | T | F | T | S | D | Y | S | K | Y | L | D | Aib | R | R | A | Lys(C14) | E | F | V | A | W | L | L | N | T | # |
| EU-A929 | 537 | H | G | Q | G | T | F | T | S | D | Y | S | K | Y | L | D | Aib | R | R | A | Lys(C16) | E | F | V | A | W | L | L | N | T | # |
| EU-A930 | 538 | H | G | Q | G | T | F | T | S | D | Y | S | K | Y | L | D | Aib | R | R | A | Lys(C18) | E | F | V | A | W | L | L | N | T | # |
| EU-A931 | 539 | H | G | Q | G | T | F | T | S | D | Y | S | K | Y | L | D | Aib | R | R | A | Lys(C20) | E | F | V | A | W | L | L | N | T | # |
| EU-A932 | 540 | H | G | Q | G | T | F | T | S | D | Y | S | K | Y | L | D | Aib | R | A | A | R | E | F | I | A | W | L | L | N | T | # |
| EU-A933 | 541 | H | G | Q | G | T | F | T | S | D | Y | S | K | Y | L | D | Aib | Q | A | A | R | E | F | I | A | W | L | L | N | T | # |
| EU-A934 | 542 | H | G | Q | G | T | F | T | S | D | Y | S | K | Y | L | D | Aib | Q | A | A | R | E | F | I | A | W | L | L | N | T | # |
| EU-A935 | 543 | H | G | Q | G | T | F | T | S | D | Y | S | K | Y | L | D | Aib | Q | A | A | R | E | F | I | A | W | L | L | N | T | # |
| EU-A936 | 544 | H | G | Q | G | T | F | T | S | D | Y | S | K | Y | L | D | Aib | Q | A | A | R | E | F | I | A | W | L | L | N | T | # |
| EU-A937 | 545 | H | G | Q | G | T | F | T | S | D | Y | S | K | Y | L | D | Aib | Q | A | A | R | E | F | V | A | W | L | L | N | T | # |
| EU-A938 | 546 | H | G | Q | G | T | F | T | S | D | Y | S | K | Y | L | D | Aib | Q | R | A | Q | D | F | V | Lys(C8)  | W | L | L | N | T | # |
| EU-A939 | 547 | H | G | Q | G | T | F | T | S | D | Y | S | K | Y | L | D | Aib | R | R | A | Q | D | F | V | Lys(C12) | W | L | L | N | T | # |
| EU-A940 | 548 | H | G | Q | G | T | F | T | S | D | Y | S | K | Y | L | D | Aib | R | R | A | Q | D | F | V | Lys(C14) | W | L | L | N | T | # |
| EU-A941 | 549 | H | G | Q | G | T | F | T | S | D | Y | S | K | Y | L | D | Aib | R | R | A | Q | D | F | V | Lys(C16) | W | L | L | N | T | # |
| EU-A942 | 550 | H | G | Q | G | T | F | T | S | D | Y | S | K | Y | L | D | Aib | R | R | A | Q | D | F | V | Lys(C18) | W | L | L | N | T | # |

FIG. 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A943 | 551 | H | G | Q | G | T | F | T | S | D | Y | S | K | Y | L | D | Aib | R | | R | A | Q | D | F | V | Lys(C20) | W | L | N | T | # |
| EU-A944 | 552 | H | G | Q | G | T | F | T | S | D | Y | S | K | Y | L | D | E | Q | | A | A | R | E | F | - | Lys(C8) | W | L | Q | T | # |
| EU-A945 | 553 | H | G | Q | G | T | F | T | S | D | Y | S | K | Y | L | D | E | Q | | A | A | R | E | F | - | Lys(C12) | W | L | Q | T | # |
| EU-A946 | 554 | H | G | Q | G | T | F | T | S | D | Y | S | K | Y | L | D | E | Q | | A | A | R | E | F | - | Lys(C14) | W | L | Q | T | # |
| EU-A947 | 555 | H | G | Q | G | T | F | T | S | D | Y | S | K | Y | L | D | E | Q | | A | A | R | E | F | - | Lys(C16) | W | L | Q | T | # |
| EU-A948 | 556 | H | G | Q | G | T | F | T | S | D | Y | S | K | Y | L | D | E | Q | | A | A | R | E | F | - | Lys(C18) | W | L | Q | T | # |
| EU-A949 | 557 | H | G | Q | G | T | F | T | S | D | Y | S | K | Y | L | D | E | Q | | A | A | R | E | F | - | Lys(C20) | W | L | Q | T | # |
| EU-A950 | 558 | H | G | Q | G | T | F | T | S | D | Y | S | K | Y | L | D | E | Lys(C8) | | A | A | R | E | F | - | A | W | L | Q | T | # |
| EU-A951 | 559 | H | G | Q | G | T | F | T | S | D | Y | S | K | Y | L | D | E | Lys(C12) | | A | A | R | E | F | - | A | W | L | Q | T | # |
| EU-A952 | 560 | H | G | Q | G | T | F | T | S | D | Y | S | K | Y | L | D | E | Lys(C14) | | A | A | R | E | F | - | A | W | L | Q | T | # |
| EU-A953 | 561 | H | G | Q | G | T | F | T | S | D | Y | S | K | Y | L | D | E | Lys(C16) | | A | A | R | E | F | - | A | W | L | Q | T | # |
| EU-A954 | 562 | H | G | Q | G | T | F | T | S | D | Y | S | K | Y | L | D | E | Lys(C18) | | A | A | R | E | F | - | A | W | L | Q | T | # |
| EU-A955 | 563 | H | G | Q | G | T | F | T | S | D | Y | S | K | Y | L | D | E | Lys(C20) | | A | A | R | E | F | - | A | W | L | Q | T | # |
| EU-A956 | 564 | H | G | Q | G | T | F | T | S | D | Y | S | K | Y | L | D | E | Lys(C8) | | A | A | K | E | F | - | A | W | L | Q | T | # |
| EU-A957 | 565 | H | G | Q | G | T | F | T | S | D | Y | S | K | Y | L | D | E | Lys(C12) | | A | A | K | E | F | - | A | W | L | Q | T | # |
| EU-A958 | 566 | H | G | Q | G | T | F | T | S | D | Y | S | K | Y | L | D | E | Lys(C14) | | A | A | K | E | F | - | A | W | L | Q | T | # |
| EU-A959 | 567 | H | G | Q | G | T | F | T | S | D | Y | S | K | Y | L | D | E | Lys(C16) | | A | A | K | E | F | - | A | W | L | Q | T | # |
| EU-A960 | 568 | H | G | Q | G | T | F | T | S | D | Y | S | K | Y | L | D | E | Lys(C18) | | A | A | K | E | F | - | A | W | L | Q | T | # |
| EU-A961 | 569 | H | G | Q | G | T | F | T | S | D | Y | S | K | Y | L | D | E | Lys(C20) | | A | A | K | E | F | - | A | W | L | Q | T | # |
| EU-A962 | 570 | H | Aib | Q | G | T | F | T | S | D | Y | S | K | Y | L | D | E | Lys(C8) | | A | A | K | E | F | - | A | W | L | Q | T | # |
| EU-A963 | 571 | H | Aib | Q | G | T | F | T | S | D | Y | S | K | Y | L | D | E | Lys(C12) | | A | A | K | E | F | - | A | W | L | Q | T | # |
| EU-A964 | 572 | H | Aib | Q | G | T | F | T | S | D | Y | S | K | Y | L | D | E | Lys(C14) | | A | A | K | E | F | - | A | W | L | Q | T | # |
| EU-A965 | 573 | H | Aib | Q | G | T | F | T | S | D | Y | S | K | Y | L | D | E | Lys(C16) | | A | A | K | E | F | - | A | W | L | Q | T | # |
| EU-A966 | 574 | H | Aib | Q | G | T | F | T | S | D | Y | S | K | Y | L | D | E | Lys(C18) | | A | A | K | E | F | - | A | W | L | Q | T | # |
| EU-A967 | 575 | H | Aib | Q | G | T | F | T | S | D | Y | S | K | Y | L | D | E | Lys(C20) | | A | A | K | E | F | - | A | W | L | Q | T | # |
| EU-A968 | 576 | H | Aib | Q | G | T | F | T | S | D | Y | S | K | Y | L | D | Aib | Lys(C8) | | A | A | R | E | F | - | A | W | L | Q | T | # |
| EU-A969 | 577 | H | Aib | Q | G | T | F | T | S | D | Y | S | K | Y | L | D | Aib | Lys(C12) | | A | A | R | E | F | - | A | W | L | Q | T | # |
| EU-A970 | 578 | H | Aib | Q | G | T | F | T | S | D | Y | S | K | Y | L | D | Aib | Lys(C14) | | A | A | R | E | F | - | A | W | L | Q | T | # |
| EU-A971 | 579 | H | Aib | Q | G | T | F | T | S | D | Y | S | K | Y | L | D | Aib | Lys(C16) | | A | A | R | E | F | - | A | W | L | Q | T | # |
| EU-A972 | 580 | H | Aib | Q | G | T | F | T | S | D | Y | S | K | Y | L | D | Aib | Lys(C18) | | A | A | R | E | F | - | A | W | L | Q | T | # |
| EU-A973 | 581 | H | Aib | Q | G | T | F | T | S | D | Y | S | K | Y | L | D | Aib | Lys(C20) | | A | A | R | E | F | - | A | W | L | Q | T | # |
| EU-A974 | 582 | H | G | Q | G | T | F | T | S | D | Y | S | K | Y | L | D | E | R | | R | A | Lys(C8) | E | F | V | Q | W | L | Q | T | # |
| EU-A975 | 583 | H | G | Q | G | T | F | T | S | D | Y | S | K | Y | L | D | E | R | | R | A | Lys(C12) | D | F | V | Q | W | L | Q | T | # |
| EU-A976 | 584 | H | G | Q | G | T | F | T | S | D | Y | S | K | Y | L | D | E | R | | R | A | Lys(C14) | D | F | V | Q | W | L | Q | T | # |
| EU-A977 | 585 | H | G | Q | G | T | F | T | S | D | Y | S | K | Y | L | D | E | R | | R | A | Lys(C16) | D | F | V | Q | W | L | Q | T | # |

FIG. 3 (Continued)
Table 3 (Continued)

| SEQ. ID NO. | Name | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| 586 | EU-A978 | H | G | Q | G | T | F | T | S | D | Y | S | K | Y | L | D | E | R | R | A | R | Lys(C18) | D | F | V | Q | W | L | Q | T | # |
| 587 | EU-A979 | H | G | Q | G | T | F | T | S | D | Y | S | K | Y | L | D | E | R | R | A | R | Lys(C20) | D | F | V | Q | W | L | Q | T | # |
| 588 | EU-A980 | H | Aib | Q | G | T | F | T | S | D | Y | S | K | Y | L | D | E | R | R | A | R | Lys(C8) | D | F | V | Q | W | L | Q | T | # |
| 589 | EU-A981 | H | Aib | Q | G | T | F | T | S | D | Y | S | K | Y | L | D | E | R | R | A | R | Lys(C12) | D | F | V | Q | W | L | Q | T | # |
| 590 | EU-A982 | H | Aib | Q | G | T | F | T | S | D | Y | S | K | Y | L | D | E | R | R | A | R | Lys(C14) | D | F | V | Q | W | L | Q | T | # |
| 591 | EU-A983 | H | Aib | Q | G | T | F | T | S | D | Y | S | K | Y | L | D | E | R | R | A | R | Lys(C16) | D | F | V | Q | W | L | Q | T | # |
| 592 | EU-A984 | H | Aib | Q | G | T | F | T | S | D | Y | S | K | Y | L | D | E | R | R | A | R | Lys(C18) | D | F | V | Q | W | L | Q | T | # |
| 593 | EU-A985 | H | Aib | Q | G | T | F | T | S | D | Y | S | K | Y | L | D | E | R | R | A | R | Lys(C20) | D | F | V | Q | W | L | Q | T | # |
| 594 | EU-A986 | H | Aib | Q | G | T | F | T | S | D | Y | S | K | Y | L | D | E* | Q | A | A | K* | E | F | – | Lys(C8) | W | L | Q | T | # |
| 595 | EU-A987 | H | Aib | Q | G | T | F | T | S | D | Y | S | K | Y | L | D | E* | Q | A | A | K* | E | F | – | Lys(C12) | W | L | Q | T | # |
| 596 | EU-A988 | H | Aib | Q | G | T | F | T | S | D | Y | S | K | Y | L | D | E* | Q | A | A | K* | E | F | – | Lys(C14) | W | M | Q | T | # |
| 597 | EU-A989 | H | Aib | Q | G | T | F | T | S | D | Y | S | K | Y | L | D | E* | Q | A | A | K* | E | F | – | Lys(C16) | W | M | Q | T | # |
| 598 | EU-A990 | H | Aib | Q | G | T | F | T | S | D | Y | S | K | Y | L | D | E* | Q | A | A | K* | E | F | – | Lys(C18) | W | M | Q | T | # |
| 599 | EU-A991 | H | Aib | Q | G | T | F | T | S | D | Y | S | K | Y | L | D | E* | Q | A | A | K* | E | F | – | Lys(C20) | W | M | Q | T | # |
| 600 | EU-A992 | H | Aib | Q | G | T | F | T | S | D | Y | S | K | Y | L | D | E* | Q | A | A | K* | E | F | – | Lys(C8) | W | L | Q | T | # |
| 601 | EU-A993 | H | Aib | Q | G | T | F | T | S | D | Y | S | K | Y | L | D | E* | Q | A | A | K* | E | F | – | Lys(C12) | W | L | Q | T | # |
| 602 | EU-A994 | H | Aib | Q | G | T | F | T | S | D | Y | S | K | Y | L | D | E* | Q | A | A | K* | E | F | – | Lys(C14) | W | L | Q | T | # |
| 603 | EU-A995 | H | Aib | Q | G | T | F | T | S | D | Y | S | K | Y | L | D | E* | Q | A | A | K* | E | F | – | Lys(C16) | W | L | Q | T | # |
| 604 | EU-A996 | H | Aib | Q | G | T | F | T | S | D | Y | S | K | Y | L | D | E* | Q | A | A | K* | E | F | – | Lys(C18) | W | L | Q | T | # |
| 605 | EU-A997 | H | Aib | Q | G | T | F | T | S | D | Y | S | K | Y | L | D | E* | Q | A | A | K* | E | F | – | Lys(C20) | W | L | Q | T | # |
| 606 | EU-A998 | H | Aib | Q | G | T | F | T | S | D | Y | S | K | Y | L | D | E* | Q | A | A | K* | E | F | – | Lys(C8) | W | L | Q | T | # |
| 607 | EU-A999 | H | Aib | Q | G | T | F | T | S | D | Y | S | K | Y | L | D | E* | Q | A | A | K* | E | F | – | Lys(M8) | W | L | Q | T | # |
| 608 | EU-A1000 | H | Aib | Q | G | T | F | T | S | D | Y | S | K | Y | L | D | E* | Q | A | A | K* | E | F | – | Lys(M12) | W | L | Q | T | # |
| 609 | EU-A1001 | H | Aib | Q | G | T | F | T | S | D | Y | S | K | Y | L | D | E* | Q | A | A | K* | E | F | – | Lys(M14) | W | L | Q | T | # |
| 610 | EU-A1002 | H | Aib | Q | G | T | F | T | S | D | Y | S | K | Y | L | D | E* | Q | A | A | K* | E | F | – | Lys(M16) | W | L | Q | T | # |
| 611 | EU-A1003 | H | G | Q | G | T | F | T | S | D | Y | S | K | Y | L | D | E* | Q | A | A | K* | E | F | – | Lys(M18) | W | L | Q | T | # |
| 612 | EU-A1004 | H | G | Q | G | T | F | T | S | D | Y | S | K | Y | L | D | E | Q | A | A | R | E | F | – | Lys(M20) | W | L | Q | T | # |
| 613 | EU-A1005 | H | G | Q | G | T | F | T | S | D | Y | S | K | Y | L | D | E | Q | A | A | R | E | F | – | Lys(M8) | W | L | Q | T | # |
| 614 | EU-A1006 | H | G | Q | G | T | F | T | S | D | Y | S | K | Y | L | D | E | Q | A | A | R | E | F | – | Lys(M12) | W | L | Q | T | # |
| 615 | EU-A1007 | H | G | Q | G | T | F | T | S | D | Y | S | K | Y | L | D | E | Q | A | A | R | E | F | – | Lys(M14) | W | L | Q | T | # |
| 616 | EU-A1008 | H | G | Q | G | T | F | T | S | D | Y | S | K | Y | L | D | E | Q | A | A | R | E | F | – | Lys(M16) | W | L | Q | T | # |
| 617 | EU-A1009 | H | G | Q | G | T | F | T | S | D | Y | S | K | Y | L | D | E | Q | A | A | R | E | F | – | Lys(M18) | W | L | Q | T | # |
| 618 | EU-A1010 | H | G | Q | G | T | F | T | S | D | Y | S | K | Y | L | D | E | Lys(M8) | A | A | K | E | F | – | Lys(M20) | W | L | N | T | # |
| 619 | EU-A1011 | H | G | Q | G | T | F | T | S | D | Y | S | K | Y | L | D | E | Lys(M12) | A | A | K | E | F | – | A | W | L | N | T | # |
| 620 | EU-A1012 | H | G | Q | G | T | F | T | S | D | Y | S | K | Y | L | D | E | Lys(M14) | A | A | K | E | F | – | A | W | L | N | T | # |

FIG. 3 (Continued)
Table 3 (Continued)

| | SEQ. ID. NO. | 1 | | | | 5 | | | | | 10 | | | | | 15 | | | | | 20 | | | | | 25 | | | | | 30 | |
|---|---|---|---|---|---|---|---|---|---|---|---|---|---|---|---|---|---|---|---|---|---|---|---|---|---|---|---|---|---|---|---|---|
| EU-A1013 | 621 | H | G | Q | G | T | F | T | S | D | Y | S | K | Y | L | D | E | Lys(M16) | A | A | K | E | F | I | W | | L | Q | T | # | |
| EU-A1014 | 622 | H | G | Q | G | T | F | T | S | D | Y | S | K | Y | L | D | E | Lys(M18) | A | A | K | E | F | I | W | | L | N | T | # | |
| EU-A1015 | 623 | H | G | Q | G | T | F | T | S | D | Y | S | K | Y | L | D | E | Lys(M20) | A | A | K | E | F | I | W | | L | N | T | # | |
| EU-A1016 | 624 | H | G | Q | G | T | F | T | S | D | Y | S | K | Y | L | D | E | Lys(M8) | A | A | R | E | F | I | W | A | L | N | T | # | |
| EU-A1017 | 625 | H | G | Q | G | T | F | T | S | D | Y | S | K | Y | L | D | E | Lys(M12) | A | A | R | E | F | I | W | A | L | Q | T | # | |
| EU-A1018 | 626 | H | G | Q | G | T | F | T | S | D | Y | S | K | Y | L | D | E | Lys(M14) | A | A | R | E | F | I | W | A | L | Q | T | # | |
| EU-A1019 | 627 | H | G | Q | G | T | F | T | S | D | Y | S | K | Y | L | D | E | Lys(M16) | A | A | R | E | F | I | W | A | L | Q | T | # | |
| EU-A1020 | 628 | H | G | Q | G | T | F | T | S | D | Y | S | K | Y | L | D | E | Lys(M18) | A | A | R | E | F | I | W | A | L | Q | T | # | |
| EU-A1021 | 629 | H | G | Q | G | T | F | T | S | D | Y | S | K | Y | L | D | E | Lys(M20) | A | A | R | E | F | I | W | A | L | Q | T | # | |
| EU-A1022 | 630 | H | Aib | Q | G | T | F | T | S | D | Y | S | K | Y | L | D | E* | Q | A | A | R | E | F | I | W | A | L | Q | T | # | |
| EU-A1023 | 631 | H | Aib | Q | G | T | F | T | S | D | Y | S | K | Y | L | D | E* | Q | A | A | K* | E | F | I | W | Lys(Me8) | L | Q | T | # | |
| EU-A1024 | 632 | H | Aib | Q | G | T | F | T | S | D | Y | S | K | Y | L | D | E* | Q | A | A | K* | E | F | I | W | Lys(Me12) | L | Q | T | # | |
| EU-A1025 | 633 | H | Aib | Q | G | T | F | T | S | D | Y | S | K | Y | L | D | E* | Q | A | A | K* | E | F | I | W | Lys(Me14) | L | Q | T | # | |
| EU-A1026 | 634 | H | Aib | Q | G | T | F | T | S | D | Y | S | K | Y | L | D | E* | Q | A | A | K* | E | F | I | W | Lys(Me16) | L | Q | T | # | |
| EU-A1027 | 635 | H | Aib | Q | G | T | F | T | S | D | Y | S | K | Y | L | D | E* | Q | A | A | K* | E | F | I | W | Lys(Me18) | L | Q | T | # | |
| EU-A1028 | 636 | H | G | Q | G | T | F | T | S | D | Y | S | K | Y | L | D | E | Q | A | A | K* | E | F | I | W | Lys(Me20) | L | Q | T | # | |
| EU-A1029 | 637 | H | G | Q | G | T | F | T | S | D | Y | S | K | Y | L | D | E | Q | A | A | R | E | F | I | W | Lys(Me8) | L | Q | T | # | |
| EU-A1030 | 638 | H | G | Q | G | T | F | T | S | D | Y | S | K | Y | L | D | E | Q | A | A | R | E | F | I | W | Lys(Me12) | L | Q | T | # | |
| EU-A1031 | 639 | H | G | Q | G | T | F | T | S | D | Y | S | K | Y | L | D | E | Q | A | A | R | E | F | I | W | Lys(Me14) | L | Q | T | # | |
| EU-A1032 | 640 | H | G | Q | G | T | F | T | S | D | Y | S | K | Y | L | D | E | Q | A | A | R | E | F | I | W | Lys(Me16) | L | Q | T | # | |
| EU-A1033 | 641 | H | G | Q | G | T | F | T | S | D | Y | S | K | Y | L | D | E | Q | A | A | R | E | F | I | W | Lys(Me18) | L | Q | T | # | |
| EU-A1034 | 642 | H | G | Q | G | T | F | T | S | D | Y | S | K | Y | L | D | E | Q | A | A | R | E | F | I | W | Lys(Me20) | L | Q | T | # | |
| EU-A1035 | 643 | H | G | Q | G | T | F | T | S | D | Y | S | K | Y | L | D | E | Lys(Me8) | A | A | K | E | F | I | W | A | L | N | T | # | |
| EU-A1036 | 644 | H | G | Q | G | T | F | T | S | D | Y | S | K | Y | L | D | E | Lys(Me12) | A | A | K | E | F | I | W | A | L | N | T | # | |
| EU-A1037 | 645 | H | G | Q | G | T | F | T | S | D | Y | S | K | Y | L | D | E | Lys(Me14) | A | A | K | E | F | I | W | A | L | N | T | # | |
| EU-A1038 | 646 | H | G | Q | G | T | F | T | S | D | Y | S | K | Y | L | D | E | Lys(Me16) | A | A | K | E | F | I | W | A | L | N | T | # | |
| EU-A1039 | 647 | H | G | Q | G | T | F | T | S | D | Y | S | K | Y | L | D | E | Lys(Me18) | A | A | K | E | F | I | W | A | L | N | T | # | |
| EU-A1040 | 648 | H | G | Q | G | T | F | T | S | D | Y | S | K | Y | L | D | E | Lys(Me20) | A | A | K | E | F | I | W | A | L | N | T | # | |
| EU-A1041 | 649 | H | G | Q | G | T | F | T | S | D | Y | S | K | Y | L | D | E | Lys(Me8) | A | A | R | E | F | I | W | A | L | Q | T | # | |
| EU-A1042 | 650 | H | G | Q | G | T | F | T | S | D | Y | S | K | Y | L | D | E | Lys(Me12) | A | A | R | E | F | I | W | A | L | Q | T | # | |
| EU-A1043 | 651 | H | G | Q | G | T | F | T | S | D | Y | S | K | Y | L | D | E | Lys(Me14) | A | A | R | E | F | I | W | A | L | Q | T | # | |
| EU-A1044 | 652 | H | G | Q | G | T | F | T | S | D | Y | S | K | Y | L | D | E | Lys(Me16) | A | A | R | E | F | I | W | A | L | Q | T | # | |
| EU-A1045 | 653 | H | G | Q | G | T | F | T | S | D | Y | S | K | Y | L | D | E | Lys(Me18) | A | A | R | E | F | I | W | A | L | Q | T | # | |
| EU-A1046 | 654 | H | aMePro | Q | G | T | aMeF | T | S | D | EtBip | Lys(C8) | # | | | | | | | | | | | | | | | | | | |
| EU-A1047 | 655 | H | aMePro | Q | G | T | aMeF | T | S | D | EtBip | Lys(C12) | # | | | | | | | | | | | | | | | | | | |

FIG. 3 (Continued)
Table 3 (Continued)

| | SEQ. ID. NO. | 1 | | Q | G | 5 | αMeF | T | S | D | 10 | | |
|---|---|---|---|---|---|---|---|---|---|---|---|---|---|
| EU-A1048 | 656 | H | αMePro | Q | G | T | αMeF | T | S | D | EtBip | Lys(C14) | # |
| EU-A1049 | 657 | H | αMePro | Q | G | T | αMeF | T | S | D | EtBip | Lys(C16) | # |
| EU-A1050 | 658 | H | αMePro | Q | G | T | αMeF | T | S | D | EtBip | Lys(C18) | # |
| EU-A1051 | 659 | H | αMePro | Q | G | T | αMeF | T | S | D | EtBip | Lys(C20) | # |
| EU-A1052 | 660 | H | αMePro | Q | G | T | αMeFF | T | S | D | EtBip | Lys(C8) | # |
| EU-A1053 | 661 | H | αMePro | Q | G | T | αMeFF | T | S | D | EtBip | Lys(C12) | # |
| EU-A1054 | 662 | H | αMePro | Q | G | T | αMeFF | T | S | D | EtBip | Lys(C14) | # |
| EU-A1055 | 663 | H | αMePro | Q | G | T | αMeFF | T | S | D | EtBip | Lys(C16) | # |
| EU-A1056 | 664 | H | αMePro | Q | G | T | αMeFF | T | S | D | EtBip | Lys(C18) | # |
| EU-A1057 | 665 | H | αMePro | Q | G | T | αMeFF | T | S | D | EtBip | Lys(C20) | # |
| EU-A1058 | 666 | H | Aib | Q | G | T | αMeF | T | S | D | EtBip | Lys(C8) | # |
| EU-A1059 | 667 | H | Aib | Q | G | T | αMeF | T | S | D | EtBip | Lys(C12) | # |
| EU-A1060 | 668 | H | Aib | Q | G | T | αMeF | T | S | D | EtBip | Lys(C14) | # |
| EU-A1061 | 669 | H | Aib | Q | G | T | αMeF | T | S | D | EtBip | Lys(C16) | # |
| EU-A1062 | 670 | H | Aib | Q | G | T | αMeF | T | S | D | EtBip | Lys(C18) | # |
| EU-A1063 | 671 | H | Aib | Q | G | T | αMeF | T | S | D | EtBip | Lys(C20) | # |
| EU-A1064 | 672 | H | Aib | Q | G | T | αMeFF | T | S | D | EtBip | Lys(C8) | # |
| EU-A1065 | 673 | H | Aib | Q | G | T | αMeFF | T | S | D | EtBip | Lys(C12) | # |
| EU-A1066 | 674 | H | Aib | Q | G | T | αMeFF | T | S | D | EtBip | Lys(C14) | # |
| EU-A1067 | 675 | H | Aib | Q | G | T | αMeFF | T | S | D | EtBip | Lys(C16) | # |
| EU-A1068 | 676 | H | Aib | Q | G | T | αMeFF | T | S | D | EtBip | Lys(C18) | # |
| EU-A1069 | 677 | H | Aib | Q | G | T | αMeFF | T | S | D | EtBip | Lys(C20) | # |
| EU-A1070 | 678 | H | αMePro | Q | G | T | αMeF | T | S | D | EtBip | MeLys(C8) | # |
| EU-A1071 | 679 | H | αMePro | Q | G | T | αMeF | T | S | D | EtBip | MeLys(C12) | # |
| EU-A1072 | 680 | H | αMePro | Q | G | T | αMeF | T | S | D | EtBip | MeLys(C14) | # |
| EU-A1073 | 681 | H | αMePro | Q | G | T | αMeF | T | S | D | EtBip | MeLys(C16) | # |
| EU-A1074 | 682 | H | αMePro | Q | G | T | αMeF | T | S | D | EtBip | MeLys(C18) | # |
| EU-A1075 | 683 | H | αMePro | Q | G | T | αMeF | T | S | D | EtBip | MeLys(C20) | # |
| EU-A1076 | 684 | H | αMePro | Q | G | T | αMeFF | T | S | D | EtBip | MeLys(C8) | # |
| EU-A1077 | 685 | H | αMePro | Q | G | T | αMeFF | T | S | D | EtBip | MeLys(C12) | # |
| EU-A1078 | 686 | H | αMePro | Q | G | T | αMeFF | T | S | D | EtBip | MeLys(C14) | # |
| EU-A1079 | 687 | H | αMePro | Q | G | T | αMeFF | T | S | D | EtBip | MeLys(C16) | # |
| EU-A1080 | 688 | H | αMePro | Q | G | T | αMeFF | T | S | D | EtBip | MeLys(C18) | # |
| EU-A1081 | 689 | H | αMePro | Q | G | T | αMeFF | T | S | D | EtBip | MeLys(C20) | # |
| EU-A1082 | 690 | H | Aib | Q | G | T | αMeF | T | S | D | EtBip | MeLys(C8) | # |

FIG. 3 (Continued)
Table 3 (Continued)

| | SEQ. ID. NO. | 1 | | | | 5 | | | | | 10 | | | 15 | 20 | 25 | 30 |
|---|---|---|---|---|---|---|---|---|---|---|---|---|---|---|---|---|---|
| EU-A1083 | 691 | H | Aib | Q | G | T | αMeF | T | S | D | EtBip | MeLys(C12) | # | | | | |
| EU-A1084 | 692 | H | Aib | Q | G | T | αMeF | T | S | D | EtBip | MeLys(C14) | # | | | | |
| EU-A1085 | 693 | H | Aib | Q | G | T | αMeF | T | S | D | EtBip | MeLys(C16) | # | | | | |
| EU-A1086 | 694 | H | Aib | Q | G | T | αMeF | T | S | D | EtBip | MeLys(C18) | # | | | | |
| EU-A1087 | 695 | H | Aib | Q | G | T | αMeF | T | S | D | EtBip | MeLys(C20) | # | | | | |
| EU-A1088 | 696 | H | Aib | Q | G | T | αMeFF | T | S | D | EtBip | MeLys(C8) | # | | | | |
| EU-A1089 | 697 | H | Aib | Q | G | T | αMeFF | T | S | D | EtBip | MeLys(C12) | # | | | | |
| EU-A1090 | 698 | H | Aib | Q | G | T | αMeFF | T | S | D | EtBip | MeLys(C14) | # | | | | |
| EU-A1091 | 699 | H | Aib | Q | G | T | αMeFF | T | S | D | EtBip | MeLys(C16) | # | | | | |
| EU-A1092 | 700 | H | Aib | Q | G | T | αMeFF | T | S | D | EtBip | MeLys(C18) | # | | | | |
| EU-A1093 | 701 | H | Aib | Q | G | T | αMeFF | T | S | D | EtBip | MeLys(C20) | # | | | | |
| EU-A1094 | 702 | H | αMePro | Q | G | T | αMeF | T | S | D | EtBip | Me8 | # | | | | |
| EU-A1095 | 703 | H | αMePro | Q | G | T | αMeF | T | S | D | EtBip | Me12 | # | | | | |
| EU-A1096 | 704 | H | αMePro | Q | G | T | αMeF | T | S | D | EtBip | Me14 | # | | | | |
| EU-A1097 | 705 | H | αMePro | Q | G | T | αMeF | T | S | D | EtBip | Me16 | # | | | | |
| EU-A1098 | 706 | H | αMePro | Q | G | T | αMeF | T | S | D | EtBip | Me18 | # | | | | |
| EU-A1099 | 707 | H | αMePro | Q | G | T | αMeF | T | S | D | EtBip | Me20 | # | | | | |
| EU-A1100 | 708 | H | αMePro | Q | G | T | αMeFF | T | S | D | EtBip | Me8 | # | | | | |
| EU-A1101 | 709 | H | αMePro | Q | G | T | αMeFF | T | S | D | EtBip | Me12 | # | | | | |
| EU-A1102 | 710 | H | αMePro | Q | G | T | αMeFF | T | S | D | EtBip | Me14 | # | | | | |
| EU-A1103 | 711 | H | αMePro | Q | G | T | αMeFF | T | S | D | EtBip | Me16 | # | | | | |
| EU-A1104 | 712 | H | αMePro | Q | G | T | αMeFF | T | S | D | EtBip | Me18 | # | | | | |
| EU-A1105 | 713 | H | αMePro | Q | G | T | αMeFF | T | S | D | EtBip | Me20 | # | | | | |
| EU-A1106 | 714 | H | Aib | Q | G | T | αMeF | T | S | D | EtBip | Me8 | # | | | | |
| EU-A1107 | 715 | H | Aib | Q | G | T | αMeF | T | S | D | EtBip | Me12 | # | | | | |
| EU-A1108 | 716 | H | Aib | Q | G | T | αMeF | T | S | D | EtBip | Me14 | # | | | | |
| EU-A1109 | 717 | H | Aib | Q | G | T | αMeF | T | S | D | EtBip | Me16 | # | | | | |
| EU-A1110 | 718 | H | Aib | Q | G | T | αMeF | T | S | D | EtBip | Me18 | # | | | | |
| EU-A1111 | 719 | H | Aib | Q | G | T | αMeF | T | S | D | EtBip | Me20 | # | | | | |
| EU-A1112 | 720 | H | Aib | Q | G | T | αMeFF | T | S | D | EtBip | Me8 | # | | | | |
| EU-A1113 | 721 | H | Aib | Q | G | T | αMeFF | T | S | D | EtBip | Me12 | # | | | | |
| EU-A1114 | 722 | H | Aib | Q | G | T | αMeFF | T | S | D | EtBip | Me14 | # | | | | |
| EU-A1115 | 723 | H | Aib | Q | G | T | αMeFF | T | S | D | EtBip | Me16 | # | | | | |
| EU-A1116 | 724 | H | Aib | Q | G | T | αMeFF | T | S | D | EtBip | Me18 | # | | | | |
| EU-A1117 | 725 | H | Aib | Q | G | T | αMeFF | T | S | D | EtBip | Me20 | # | | | | |

FIG. 3 (Continued)
Table 3 (Continued)

| | SEQ. ID. NO. | 1 | 2 | 3 | 4 | 5 | 6 | 7 | 8 | 9 | 10 | 11 | 12 |
|---|---|---|---|---|---|---|---|---|---|---|---|---|---|
| EU-A1118 | 726 | H | αMePro | Q | G | T | αMeF | T | S | D | Bip | MeLys(C8) | # |
| EU-A1119 | 727 | H | αMePro | Q | G | T | αMeF | T | S | D | Bip | MeLys(C12) | # |
| EU-A1120 | 728 | H | αMePro | Q | G | T | αMeF | T | S | D | Bip | MeLys(C14) | # |
| EU-A1121 | 729 | H | αMePro | Q | G | T | αMeF | T | S | D | Bip | MeLys(C16) | # |
| EU-A1122 | 730 | H | αMePro | Q | G | T | αMeF | T | S | D | Bip | MeLys(C18) | # |
| EU-A1123 | 731 | H | αMePro | Q | G | T | αMeF | T | S | D | Bip | MeLys(C20) | # |
| EU-A1124 | 732 | H | αMePro | Q | G | T | αMeFF | T | S | D | Bip | MeLys(C8) | # |
| EU-A1125 | 733 | H | αMePro | Q | G | T | αMeFF | T | S | D | Bip | MeLys(C12) | # |
| EU-A1126 | 734 | H | αMePro | Q | G | T | αMeFF | T | S | D | Bip | MeLys(C14) | # |
| EU-A1127 | 735 | H | αMePro | Q | G | T | αMeFF | T | S | D | Bip | MeLys(C16) | # |
| EU-A1128 | 736 | H | αMePro | Q | G | T | αMeFF | T | S | D | Bip | MeLys(C18) | # |
| EU-A1129 | 737 | H | αMePro | Q | G | T | αMeFF | T | S | D | Bip | MeLys(C20) | # |
| EU-A1130 | 738 | H | Aib | Q | G | T | αMeF | T | S | D | Bip | MeLys(C8) | # |
| EU-A1131 | 739 | H | Aib | Q | G | T | αMeF | T | S | D | Bip | MeLys(C12) | # |
| EU-A1132 | 740 | H | Aib | Q | G | T | αMeF | T | S | D | Bip | MeLys(C14) | # |
| EU-A1133 | 741 | H | Aib | Q | G | T | αMeF | T | S | D | Bip | MeLys(C16) | # |
| EU-A1134 | 742 | H | Aib | Q | G | T | αMeF | T | S | D | Bip | MeLys(C18) | # |
| EU-A1135 | 743 | H | Aib | Q | G | T | αMeF | T | S | D | Bip | MeLys(C20) | # |
| EU-A1136 | 744 | H | Aib | Q | G | T | αMeFF | T | S | D | Bip | MeLys(C8) | # |
| EU-A1137 | 745 | H | Aib | Q | G | T | αMeFF | T | S | D | Bip | MeLys(C12) | # |
| EU-A1138 | 746 | H | Aib | Q | G | T | αMeFF | T | S | D | Bip | MeLys(C14) | # |
| EU-A1139 | 747 | H | Aib | Q | G | T | αMeFF | T | S | D | Bip | MeLys(C16) | # |
| EU-A1140 | 748 | H | Aib | Q | G | T | αMeFF | T | S | D | Bip | MeLys(C18) | # |
| EU-A1141 | 749 | H | Aib | Q | G | T | αMeFF | T | S | D | Bip | MeLys(C20) | # |
| EU-A1142 | 750 | H | αMePro | Q | G | T | αMeF | T | S | D | Bip | Me8 | |
| EU-A1143 | 751 | H | αMePro | Q | G | T | αMeF | T | S | D | Bip | Me12 | |
| EU-A1144 | 752 | H | αMePro | Q | G | T | αMeF | T | S | D | Bip | Me14 | |
| EU-A1145 | 753 | H | αMePro | Q | G | T | αMeF | T | S | D | Bip | Me16 | |
| EU-A1146 | 754 | H | αMePro | Q | G | T | αMeF | T | S | D | Bip | Me18 | |
| EU-A1147 | 755 | H | αMePro | Q | G | T | αMeF | T | S | D | Bip | Me20 | |
| EU-A1148 | 756 | H | αMePro | Q | G | T | αMeFF | T | S | D | Bip | Me8 | |
| EU-A1149 | 757 | H | αMePro | Q | G | T | αMeFF | T | S | D | Bip | Me12 | |
| EU-A1150 | 758 | H | αMePro | Q | G | T | αMeFF | T | S | D | Bip | Me14 | |
| EU-A1151 | 759 | H | αMePro | Q | G | T | αMeFF | T | S | D | Bip | Me16 | # |

FIG. 3 (Continued)
Table 3 (Continued)

| | SEQ. ID. NO. | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A1152 | 760 | H | αMePro | Q | G | T | αMeFF | T | S | D | Bip | Me18 | # | | | | | | | | | | | | | | | | | | |
| EU-A1153 | 761 | H | αMePro | Q | G | T | αMeFF | T | S | D | Bip | Me20 | # | | | | | | | | | | | | | | | | | | |
| EU-A1154 | 762 | H | Aib | Q | G | T | αMeF | T | S | D | Bip | Me8 | # | | | | | | | | | | | | | | | | | | |
| EU-A1155 | 763 | H | Aib | Q | G | T | αMeF | T | S | D | Bip | Me12 | # | | | | | | | | | | | | | | | | | | |
| EU-A1156 | 764 | H | Aib | Q | G | T | αMeF | T | S | D | Bip | Me14 | # | | | | | | | | | | | | | | | | | | |
| EU-A1157 | 765 | H | Aib | Q | G | T | αMeF | T | S | D | Bip | Me16 | # | | | | | | | | | | | | | | | | | | |
| EU-A1158 | 766 | H | Aib | Q | G | T | αMeF | T | S | D | Bip | Me18 | # | | | | | | | | | | | | | | | | | | |
| EU-A1159 | 767 | H | Aib | Q | G | T | αMeF | T | S | D | Bip | Me20 | # | | | | | | | | | | | | | | | | | | |
| EU-A1160 | 768 | H | Aib | Q | G | T | αMeFF | T | S | D | Bip | Me8 | # | | | | | | | | | | | | | | | | | | |
| EU-A1161 | 769 | H | Aib | Q | G | T | αMeFF | T | S | D | Bip | Me12 | # | | | | | | | | | | | | | | | | | | |
| EU-A1162 | 770 | H | Aib | Q | G | T | αMeFF | T | S | D | Bip | Me14 | # | | | | | | | | | | | | | | | | | | |
| EU-A1163 | 771 | H | Aib | Q | G | T | αMeFF | T | S | D | Bip | Me16 | # | | | | | | | | | | | | | | | | | | |
| EU-A1164 | 772 | H | Aib | Q | G | T | αMeFF | T | S | D | Bip | Me18 | # | | | | | | | | | | | | | | | | | | |
| EU-A1165 | 773 | H | Aib | Q | G | T | αMeFF | T | S | D | Bip | Me20 | # | | | | | | | | | | | | | | | | | | |
| EU-A1166 | 798 | H | Aib | Q | G | T | F | T | S | D | Y | S | K | Y | L | D | E* | Q | A | K* | E | F | — | | | | | | | | |
| EU-A1167 | 799 | H | Aib | Q | G | T | F | T | S | D | Y | S | K | Y | L | D | E* | Q | A | K* | E | F | Lys(C9) | W | L | L | Q | T | # |
| EU-A1168 | 800 | H | Aib | Q | G | T | F | T | S | D | Y | S | K | Y | L | D | E* | Q | A | K* | E | F | Lys(C10) | W | L | L | Q | T | # |
| EU-A1169 | 801 | H | Aib | Q | G | T | F | T | S | D | Y | S | K | Y | L | D | E* | Q | A | K* | E | F | Lys(C11) | W | L | L | Q | T | # |
| EU-A1170 | 802 | H | Aib | Q | G | T | F | T | S | D | Y | S | K | Y | L | D | E* | Q | A | K* | E | F | Lys(Me*8) | W | L | L | Q | T | # |
| EU-A1171 | 803 | H | Aib | Q | G | T | F | T | S | D | Y | S | K | Y | L | D | E* | Q | A | K* | E | F | Lys(Me*10) | W | L | L | Q | T | # |
| EU-A1172 | 804 | H | Aib | Q | G | T | F | T | S | D | Y | S | K | Y | L | D | E* | Q | A | K* | E | F | Lys(Me*12) | W | L | L | Q | T | # |
| EU-A1173 | 805 | H | Aib | Q | G | T | F | T | S | D | Y | S | K | Y | L | D | E* | Q | A | K* | E | F | Lys(Me*14) | W | L | L | Q | T | # |
| EU-A1174 | 806 | H | Aib | Q | G | T | F | T | S | D | Y | S | K | Y | L | D | E* | Q | A | K* | E | F | Lys(Me*16) | W | L | L | Q | T | # |
| | | | | | | | | | | | | | | | | | | | | | | | | Lys(Me*18) | W | L | L | Q | T | # |

C with a numeral means 1-alkyl beta-D-glucouronyl acyl group, while the numeral denotes the chain length.

MeLys = C-alpha-methyl-lysine, EtBip = 2'-ethyl-biphenylalanine; αMeF = C-α-methyl-Phe; αMeFF = C-α-methyl-2-fluoro-Phe M is maltoside and Me is melibioside-based surfactant, while the numeral is the carbon chain length of the 1-alkyl substitution. Starred means alpha linked glycoside. For example Me* means alpha- melibioside.

Lys(C12) means N-epsilon-(1'-dodecyl beta-D-glucuronyl)-L-lysine and other C numbers mean the corresponding 1'-alkyl glucoronide. The pair of amino acids E*, K* or K*, E* separated by 4 residues denotes a side chain lactam linkage formed between the side chain functional groups on these amino acids.

# means amide C-terminus.

FIG. 4
Table 4

| | SEQ ID NO | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 |
|---|---|---|---|---|---|---|---|---|---|---|---|---|---|---|---|---|---|---|---|---|---|---|---|---|---|---|---|---|---|---|---|
| EU-A1575 | 807 | H | Aib | Q | G | T | F | T | S | D | Y | S | K | Y | L | D | E* | Q | A | A | K* | Lys(Me10) | E | F | I | W | L | L | Q | T | OH |
| EU-A1576 | 808 | H | Aib | Q | G | T | F | T | S | D | Y | S | K | Y | L | D | E* | Q | A | A | K* | Lys(Me12) | E | F | I | W | L | L | Q | T | OH |
| EU-A1577 | 809 | H | Aib | Q | G | T | F | T | S | D | Y | S | K | Y | L | D | E* | Q | A | A | K* | Lys(Me14) | E | F | I | W | L | L | Q | T | OH |
| EU-A1578 | 810 | H | Aib | Q | G | T | F | T | S | D | Y | S | K | Y | L | D | E* | Q | A | A | K* | Lys(Me16) | E | F | I | W | L | L | Q | T | OH |
| EU-A1579 | 811 | H | Aib | Q | G | T | F | T | S | D | Y | S | K | Y | L | D | E* | Q | A | A | K* | Lys(Me18) | E | F | I | W | L | L | Q | T | OH |
| EU-A1580 | 812 | H | Aib | Q | G | T | F | T | S | D | Y | S | K | Y | L | D | E* | E | A | A | K* | Lys(Me10) | E | F | I | W | L | L | Q | T | OH |
| EU-A1581 | 813 | H | Aib | Q | G | T | F | T | S | D | Y | S | K | Y | L | D | E* | E | A | A | K* | Lys(Me12) | E | F | I | W | L | L | Q | T | OH |
| EU-A1582 | 814 | H | Aib | Q | G | T | F | T | S | D | Y | S | K | Y | L | D | E* | E | A | A | K* | Lys(Me14) | E | F | I | W | L | L | Q | T | OH |
| EU-A1583 | 815 | H | Aib | Q | G | T | F | T | S | D | Y | S | K | Y | L | D | E* | E | A | A | K* | Lys(Me16) | E | F | I | W | L | L | Q | T | OH |
| EU-A1584 | 816 | H | Aib | Q | G | T | F | T | S | D | Y | S | K | Y | L | D | E* | E | A | A | K* | Lys(Me18) | E | F | I | W | L | L | Q | T | # |
| EU-A1585 | 817 | H | Aib | Q | G | T | F | T | S | D | Y | S | K | Y | L | D | E* | Lys(Me10) | A | A | K* | Q | E | F | I | W | L | L | Q | T | # |
| EU-A1586 | 818 | H | Aib | Q | G | T | F | T | S | D | Y | S | K | Y | L | D | E* | Lys(Me12) | A | A | K* | Q | E | F | I | W | L | L | Q | T | # |
| EU-A1587 | 819 | H | Aib | Q | G | T | F | T | S | D | Y | S | K | Y | L | D | E* | Lys(Me14) | A | A | K* | Q | E | F | I | W | L | L | Q | T | # |
| EU-A1588 | 820 | H | Aib | Q | G | T | F | T | S | D | Y | S | K | Y | L | D | E* | Lys(Me16) | A | A | K* | Q | E | F | I | W | L | L | Q | T | # |
| EU-A1589 | 821 | H | Aib | Q | G | T | F | T | S | D | Y | S | K | Y | L | D | E* | Lys(Me18) | A | A | K* | Q | E | F | I | W | L | L | Q | T | OH |
| EU-A1590 | 822 | H | Aib | Q | G | T | F | T | S | D | Y | S | K | Y | L | D | E* | Lys(Me12) | A | A | K* | Q | E | F | I | W | L | L | Q | T | # |
| EU-A1591 | 823 | H | Aib | Q | G | T | F | T | S | D | Y | S | K | Y | L | D | E* | Lys(Me12) | A | A | K* | E | E | F | I | W | L | L | Q | T | OH |
| EU-A1592 | 824 | H | Aib | Q | G | T | F | T | S | D | Y | S | K | Y | L | D | E* | Lys(Me12) | A | A | K* | Q | E | F | I | W | L | L | Q | T | # |
| EU-A1593 | 825 | H | Aib | Q | G | T | F | T | S | D | Lys(Me10) | S | K | Y | L | D | E* | Q | A | A | K* | Q | E | F | I | W | L | L | Q | T | # |

FIG. 4 (Continued)
Table 4 (Continued)

| | SEQ ID NO | 1 | | | | 5 | | | | | 10 | | | | | 15 | | | | | 20 | | | | | 25 | | | | 29 | 30 |
|---|---|---|---|---|---|---|---|---|---|---|---|---|---|---|---|---|---|---|---|---|---|---|---|---|---|---|---|---|---|---|---|
| EU-A1594 | 826 | H | Alb | Q | G | T | F | T | S | D | Lys(Me12) | S | K | Y | L | D | E* | | A | A | K* | E | F | I | Q | W | L | L | Q | T | # |
| EU-A1595 | 827 | H | Alb | Q | G | T | F | T | S | D | Lys(Me14) | S | K | Y | L | D | E* | | A | A | K* | E | F | I | Q | W | L | L | Q | T | # |
| EU-A1596 | 828 | H | Alb | Q | G | T | F | T | S | D | Lys(Me16) | S | K | Y | L | D | E* | | A | A | K* | E | F | I | Q | W | L | L | Q | T | # |
| EU-A1597 | 829 | H | Alb | Q | G | T | F | T | S | D | Lys(Me18) | S | K | Y | L | D | E* | | A | A | K* | E | F | I | Q | W | L | L | Q | T | # |
| EU-A1598 | 830 | H | Alb | Q | G | T | F | T | S | D | Lys(Me12) | S | K | Y | L | D | E* | | A | A | K* | E | F | I | Q | W | L | L | Q | T | # |
| EU-A1599 | 831 | H | Alb | Q | G | T | F | T | S | D | Lys(Me12) | S | K | Y | L | D | E* | | A | A | K* | E | F | I | E | W | L | L | Q | T | OH |
| EU-A1600 | 832 | H | Alb | Q | G | T | F | T | S | D | Y | S | K | Y | L | D | E* | Q | A | A | K* | E | F | I | E | W | L | L | Q | T | # |
| EU-A1601 | 833 | H | Alb | Q | G | T | F | T | S | D | Y | S | K | Y | L | D | E* | Q | A | A | K* | E | F | I | LysS1(Me10) | W | L | L | Q | T | # |
| EU-A1602 | 834 | H | Alb | Q | G | T | F | T | S | D | Y | S | K | Y | L | D | E* | Q | A | A | K* | E | F | I | LysS1(Me12) | W | L | L | Q | T | # |
| EU-A1603 | 835 | H | Alb | Q | G | T | F | T | S | D | Y | S | K | Y | L | D | E* | Q | A | A | K* | E | F | I | LysS1(Me14) | W | L | L | Q | T | # |
| EU-A1604 | 836 | H | Alb | Q | G | T | F | T | S | D | Y | S | K | Y | L | D | E* | Q | A | A | K* | E | F | I | LysS1(Me16) | W | L | L | Q | T | # |
| EU-A1605 | 837 | H | Alb | Q | G | T | F | T | S | D | Y | S | K | Y | L | D | E* | Q | A | A | K* | E | F | I | LysS1(Me18) | W | L | L | Q | T | # |
| EU-A1606 | 838 | H | Alb | Q | G | T | F | T | S | D | Y | S | K | Y | L | D | E* | Q | A | A | K* | E | F | I | LysS2(Me10) | W | L | L | Q | T | # |
| EU-A1607 | 839 | H | Alb | Q | G | T | F | T | S | D | Y | S | K | Y | L | D | E* | Q | A | A | K* | E | F | I | LysS2(Me12) | W | L | L | Q | T | # |
| EU-A1608 | 840 | H | Alb | Q | G | T | F | T | S | D | Y | S | K | Y | L | D | E* | Q | A | A | K* | E | F | I | LysS2(Me14) | W | L | L | Q | T | # |
| EU-A1609 | 841 | H | Alb | Q | G | T | F | T | S | D | Y | S | K | Y | L | D | E* | Q | A | A | K* | E | F | I | LysS2(Me16) | W | L | L | Q | T | # |
| EU-A1610 | 842 | H | Alb | Q | G | T | F | T | S | D | Y | S | K | Y | L | D | E* | Q | A | A | K* | E | F | I | LysS2(Me18) | W | L | L | Q | T | OH |
| EU-A1611 | 843 | H | Alb | Q | G | T | F | T | S | D | Y | S | K | Y | L | D | E* | Q | A | A | K* | E | F | I | LysS1(Me10) | W | L | L | Q | T | OH |
| EU-A1612 | 844 | H | Alb | Q | G | T | F | T | S | D | Y | S | K | Y | L | D | E* | Q | A | A | K* | E | F | I | LysS1(Me12) | W | L | L | Q | T | OH |
| EU-A1613 | 845 | H | Alb | Q | G | T | F | T | S | D | Y | S | K | Y | L | D | E* | Q | A | A | K* | E | F | I | LysS1(Me14) | W | L | L | Q | T | OH |
| EU-A1614 | 846 | H | Alb | Q | G | T | F | T | S | D | Y | S | K | Y | L | D | E* | Q | A | A | K* | E | F | I | LysS1(Me16) | W | L | L | Q | T | OH |

FIG. 4 (Continued)
Table 4 (Continued)

| | SEQ ID NO | 1 | | | | 5 | | | | | 10 | | | | | 15 | | | | 20 | | | | | | 25 | | | | | 29 | 30 |
|---|---|---|---|---|---|---|---|---|---|---|---|---|---|---|---|---|---|---|---|---|---|---|---|---|---|---|---|---|---|---|---|---|
| EU-A1615 | 847 | H | Aib | Q | G | T | F | T | S | D | Y | S | K | Y | L | D | E* | Q | A | A | K* | E | F | I | | W | L | L | Q | T | OH |
| EU-A1616 | 848 | H | Aib | Q | G | T | F | T | S | D | Y | S | K | Y | L | D | E* | Q | A | A | K* | E | F | I | LysS2(Me10) | W | L | L | Q | T | OH |
| EU-A1617 | 849 | H | Aib | Q | G | T | F | T | S | D | Y | S | K | Y | L | D | E* | Q | A | A | K* | E | F | I | LysS2(Me12) | W | L | L | Q | T | OH |
| EU-A1618 | 850 | H | Aib | Q | G | T | F | T | S | D | Y | S | K | Y | L | D | E* | Q | A | A | K* | E | F | I | LysS2(Me14) | W | L | L | Q | T | OH |
| EU-A1619 | 851 | H | Aib | Q | G | T | F | T | S | D | Y | S | K | Y | L | D | E* | Q | A | A | K* | E | F | I | LysS2(Me16) | W | L | L | Q | T | OH |
| EU-A1620 | 852 | H | Aib | Q | G | T | F | T | S | D | Y | S | K | Y | L | D | E* | Q | A | A | K* | E | F | I | LysS2(Me18) | W | L | L | Q | T | OH |
| EU-A1621 | 853 | H | Aib | Q | G | T | F | T | S | D | Y | S | K | Y | L | D | E* | Q | A | A | K* | E | F | I | LysS3(Me12) | W | L | L | Q | T | OH |
| EU-A1622 | 854 | H | Aib | Q | G | T | F | T | S | D | Y | S | K | Y | L | D | E* | Q | A | A | K* | E | F | I | LysS3(Me14) | W | L | L | Q | T | OH |
| EU-A1623 | 855 | H | Aib | Q | G | T | F | T | S | D | Y | S | K | Y | L | D | E* | Q | A | A | K* | E | F | I | LysS3(Me16) | W | L | L | Q | T | OH |
| EU-A1624 | 856 | H | Aib | Q | G | T | F | T | S | D | Y | S | K | Y | L | D | E* | Q | A | A | K* | E | F | I | LysS3(Me18) | W | L | L | Q | T | OH |
| EU-A1625 | 857 | H | Aib | Q | G | T | F | T | S | D | Y | S | K | Y | L | D | E* | Q | A | A | K* | E | F | I | LysS3(Me10) | W | L | L | Q | T | # |
| EU-A1626 | 858 | H | Aib | Q | G | T | F | T | S | D | Y | S | K | Y | L | D | E* | Q | A | A | K* | E | F | I | LysS3(Me12) | W | L | L | Q | T | # |
| EU-A1627 | 859 | H | Aib | Q | G | T | F | T | S | D | Y | S | K | Y | L | D | E* | Q | A | A | K* | E | F | I | LysS3(Me14) | W | L | L | Q | T | # |
| EU-A1628 | 860 | H | Aib | Q | G | T | F | T | S | D | Y | S | K | Y | L | D | E* | Q | A | A | K* | E | F | I | LysS3(Me16) | W | L | L | Q | T | # |
| EU-A1629 | 861 | H | Aib | Q | G | T | F | T | S | D | Y | S | K | Y | L | D | E* | Q | A | A | K* | E | F | I | LysS3(Me18) | W | L | L | Q | T | # |
| EU-A1630 | 862 | H | Aib | Q | G | T | F | T | S | D | Y | S | K | Y | L | D | E* | Q | A | A | K* | E | F | I | LysS3(Me18) | W | L | L | Q | T | # |
| EU-A1631 | 863 | H | Aib | Q | G | T | F | T | S | D | Y | S | K | Y | L | D | E* | Q | A | A | K* | E | F | I | Lys(Z8) | W | L | L | Q | T | PEGa |
| EU-A1632 | 864 | H | Aib | Q | G | T | F | T | S | D | Y | S | K | Y | L | D | E* | Q | A | A | K* | E | F | I | Lys(Z10) | W | L | L | Q | T | PEGa |
| EU-A1633 | 865 | H | Aib | Q | G | T | F | T | S | D | Y | S | K | Y | L | D | E* | Q | A | A | K* | E | F | I | Lys(Z12) | W | L | L | Q | T | PEGa |
| EU-A1634 | 866 | H | Aib | Q | G | T | F | T | S | D | Y | S | K | Y | L | D | E* | Q | A | A | K* | E | F | I | Lys(Z14) | W | L | L | Q | T | PEGa |
| EU-A1635 | 867 | H | Aib | Q | G | T | F | T | S | D | Y | S | K | Y | L | D | E* | Q | A | A | K* | E | F | I | Lys(Z16) | W | L | L | Q | T | PEGa |

FIG. 4 (Continued)
Table 4 (Continued)

| | SEQ ID NO | 1 | | | | 5 | | | | | 10 | | | | | 15 | | | | | 20 | | | | | 25 | | | | | 29 | 30 |
|---|---|---|---|---|---|---|---|---|---|---|---|---|---|---|---|---|---|---|---|---|---|---|---|---|---|---|---|---|---|---|---|---|
| EU-A1636 | 868 | H | Aib | Q | G | T | F | T | S | D | Y | S | K | Y | L | D | E* | Q | A | A | K* | E | F | I | | W | L | L | Q | T | PEGa |
| EU-A1637 | 869 | H | Aib | Q | G | T | F | T | S | D | Y | S | K | Y | L | D | E* | E | A | A | K* | E | F | I | Lys(Z18) | W | L | L | Q | T | PEGa |
| EU-A1638 | 870 | H | Aib | Q | G | T | F | T | S | D | Y | S | K | Y | L | D | E* | E | A | A | K* | E | F | I | Lys(Me8) | W | L | L | Q | T | PEGa |
| EU-A1639 | 871 | H | Aib | Q | G | T | F | T | S | D | Y | S | K | Y | L | D | E* | E | A | A | K* | E | F | I | Lys(Me10) | W | L | L | Q | T | PEGa |
| EU-A1640 | 872 | H | Aib | Q | G | T | F | T | S | D | Y | S | K | Y | L | D | E* | E | A | A | K* | E | F | I | Lys(Me12) | W | L | L | Q | T | PEGa |
| EU-A1641 | 873 | H | Aib | Q | G | T | F | T | S | D | Y | S | K | Y | L | D | E* | E | A | A | K* | E | F | I | Lys(Me14) | W | L | L | Q | T | PEGa |
| EU-A1642 | 874 | H | Aib | Q | G | T | F | T | S | D | Y | S | K | Y | L | D | E* | E | A | A | K* | E | F | I | Lys(Me16) | W | L | L | Q | T | PEGa |
| EU-A1643 | 875 | H | Aib | Q | G | T | F | T | S | D | Y | S | K | Y | L | D | E* | E | A | A | K* | E | F | I | Lys(Me18) | W | L | L | Q | T | PEGb |
| EU-A1644 | 876 | H | Aib | Q | G | T | F | T | S | D | Y | S | K | Y | L | D | E* | Q | A | A | K* | E | F | I | Lys(Z8) | W | L | L | Q | T | PEGb |
| EU-A1645 | 877 | H | Aib | Q | G | T | F | T | S | D | Y | S | K | Y | L | D | E* | Q | A | A | K* | E | F | I | Lys(Z10) | W | L | L | Q | T | PEGb |
| EU-A1646 | 878 | H | Aib | Q | G | T | F | T | S | D | Y | S | K | Y | L | D | E* | Q | A | A | K* | E | F | I | Lys(Z12) | W | L | L | Q | T | PEGb |
| EU-A1647 | 879 | H | Aib | Q | G | T | F | T | S | D | Y | S | K | Y | L | D | E* | Q | A | A | K* | E | F | I | Lys(Z14) | W | L | L | Q | T | PEGb |
| EU-A1648 | 880 | H | Aib | Q | G | T | F | T | S | D | Y | S | K | Y | L | D | E* | Q | A | A | K* | E | F | I | Lys(Z16) | W | L | L | Q | T | PEGb |
| EU-A1649 | 881 | H | Aib | Q | G | T | F | T | S | D | Y | S | K | Y | L | D | E* | E | A | A | K* | E | F | I | Lys(Z18) | W | L | L | Q | T | PEGb |
| EU-A1650 | 882 | H | Aib | Q | G | T | F | T | S | D | Y | S | K | Y | L | D | E* | E | A | A | K* | E | F | I | Lys(Me8) | W | L | L | Q | T | PEGb |
| EU-A1651 | 883 | H | Aib | Q | G | T | F | T | S | D | Y | S | K | Y | L | D | E* | E | A | A | K* | E | F | I | Lys(Me10) | W | L | L | Q | T | PEGb |
| EU-A1652 | 884 | H | Aib | Q | G | T | F | T | S | D | Y | S | K | Y | L | D | E* | E | A | A | K* | E | F | I | Lys(Me12) | W | L | L | Q | T | PEGb |
| EU-A1653 | 885 | H | Aib | Q | G | T | F | T | S | D | Y | S | K | Y | L | D | E* | E | A | A | K* | E | F | I | Lys(Me14) | W | L | L | Q | T | PEGb |
| EU-A1654 | 886 | H | Aib | Q | G | T | F | T | S | D | Y | S | K | Y | L | D | E* | E | A | A | K* | E | F | I | Lys(Me16) | W | L | L | Q | T | PEGb |
| EU-A1655 | 887 | H | Aib | Q | G | T | F | T | S | D | Y | S | K | Y | L | D | E* | Q | A | A | K* | E | F | I | Lys(Me18) | W | L | L | Q | T | PEGc |
| EU-A1656 | 888 | H | Aib | Q | G | T | F | T | S | D | Y | S | K | Y | L | D | E* | Q | A | A | K* | E | F | I | Lys(Z8) | W | L | L | Q | T | PEGc |
| | | | | | | | | | | | | | | | | | | | | | | | | | Lys(Z10) | | | | | | |

FIG. 4 (Continued)
Table 4 (Continued)

| | SEQ ID NO | 1 | | | | 5 | | | | | 10 | | | | | 15 | | | | | 20 | | | | | 25 | | | | | 29 | 30 |
|---|---|---|---|---|---|---|---|---|---|---|---|---|---|---|---|---|---|---|---|---|---|---|---|---|---|---|---|---|---|---|---|---|
| EU-A1657 | 889 | H | Aib | Q | G | T | F | T | S | D | Y | S | K | Y | L | D | E* | | A | A | K* | E | F | | W | L | L | Q | T | PEGc |
| EU-A1658 | 890 | H | Aib | Q | G | T | F | T | S | D | Y | S | K | Y | L | D | E* | Q | A | A | K* | E | F | Lys(Z12) | W | L | L | Q | T | PEGc |
| EU-A1659 | 891 | H | Aib | Q | G | T | F | T | S | D | Y | S | K | Y | L | D | E* | Q | A | A | K* | E | F | Lys(Z14) | W | L | L | Q | T | PEGc |
| EU-A1660 | 892 | H | Aib | Q | G | T | F | T | S | D | Y | S | K | Y | L | D | E* | Q | A | A | K* | E | F | Lys(Z16) | W | L | L | Q | T | PEGc |
| EU-A1661 | 893 | H | Aib | Q | G | T | F | T | S | D | Y | S | K | Y | L | D | E* | Q | A | A | K* | E | F | Lys(Z18) | W | L | L | Q | T | PEGc |
| EU-A1662 | 894 | H | Aib | Q | G | T | F | T | S | D | Y | S | K | Y | L | D | E* | E | A | A | K* | E | F | Lys(Me8) | W | L | L | Q | T | PEGc |
| EU-A1663 | 895 | H | Aib | Q | G | T | F | T | S | D | Y | S | K | Y | L | D | E* | E | A | A | K* | E | F | Lys(Me10) | W | L | L | Q | T | PEGc |
| EU-A1664 | 896 | H | Aib | Q | G | T | F | T | S | D | Y | S | K | Y | L | D | E* | E | A | A | K* | E | F | Lys(Me12) | W | L | L | Q | T | PEGc |
| EU-A1665 | 897 | H | Aib | Q | G | T | F | T | S | D | Y | S | K | Y | L | D | E* | E | A | A | K* | E | F | Lys(Me14) | W | L | L | Q | T | PEGc |
| EU-A1666 | 898 | H | Aib | Q | G | T | F | T | S | D | Y | S | K | Y | L | D | E* | E | A | A | K* | E | F | Lys(Me16) | W | L | L | Q | T | PEGc |
| EU-A1667 | 899 | H | Aib | Q | G | T | F | T | S | D | Y | S | K | Y | L | D | E* | E | A | A | K* | E | F | Lys(Me18) | W | L | L | Q | T | PEGc |
| EU-A1668 | 900 | H | Aib | Q | G | T | F | T | S | D | Y | S | K | Y | L | D | E* | Q | A | A | K* | E | F | Lys(Z8) | W | L | L | Q | T | PEGd |
| EU-A1669 | 901 | H | Aib | Q | G | T | F | T | S | D | Y | S | K | Y | L | D | E* | Q | A | A | K* | E | F | Lys(Z10) | W | L | L | Q | T | PEGd |
| EU-A1670 | 902 | H | Aib | Q | G | T | F | T | S | D | Y | S | K | Y | L | D | E* | Q | A | A | K* | E | F | Lys(Z12) | W | L | L | Q | T | PEGd |
| EU-A1671 | 903 | H | Aib | Q | G | T | F | T | S | D | Y | S | K | Y | L | D | E* | Q | A | A | K* | E | F | Lys(Z14) | W | L | L | Q | T | PEGd |
| EU-A1672 | 904 | H | Aib | Q | G | T | F | T | S | D | Y | S | K | Y | L | D | E* | Q | A | A | K* | E | F | Lys(Z16) | W | L | L | Q | T | PEGd |
| EU-A1673 | 905 | H | Aib | Q | G | T | F | T | S | D | Y | S | K | Y | L | D | E* | Q | A | A | K* | E | F | Lys(Z18) | W | L | L | Q | T | PEGd |
| EU-A1674 | 906 | H | Aib | Q | G | T | F | T | S | D | Y | S | K | Y | L | D | E* | E | A | A | K* | E | F | Lys(Me8) | W | L | L | Q | T | PEGd |
| EU-A1675 | 907 | H | Aib | Q | G | T | F | T | S | D | Y | S | K | Y | L | D | E* | E | A | A | K* | E | F | Lys(Me10) | W | L | L | Q | T | PEGd |
| EU-A1676 | 908 | H | Aib | Q | G | T | F | T | S | D | Y | S | K | Y | L | D | E* | E | A | A | K* | E | F | Lys(Me12) | W | L | L | Q | T | PEGd |
| EU-A1677 | 909 | H | Aib | Q | G | T | F | T | S | D | Y | S | K | Y | L | D | E* | E | A | A | K* | E | F | Lys(Me14) | W | L | L | Q | T | PEGd |
| | | | | | | | | | | | | | | | | | | E | A | A | K* | E | F | Lys(Me16) | W | L | L | Q | T | PEGd |

FIG. 4 (Continued)
Table 4 (Continued)

| | SEQ ID NO | 1 | | | | 5 | | | | | 10 | | | | | 15 | | | | | 20 | | | | | 25 | | | | | 30 |
|---|---|---|---|---|---|---|---|---|---|---|---|---|---|---|---|---|---|---|---|---|---|---|---|---|---|---|---|---|---|---|---|
| EU-A1678 | 910 | H | Aib | Q | G | T | F | T | S | D | Y | S | K | Y | L | D | E* | | A | A | K* | E | F | I | Lys(Me18) | W | L | L | Q | T | PEGd |
| EU-A1679 | 911 | H | Aib | Q | G | T | F | T | S | D | Y | S | K | Y | L | D | E* | Q | A | A | K* | E | F | I | Lys(Z8) | W | L | L | Q | T | OH |
| EU-A1680 | 912 | H | Aib | Q | G | T | F | T | S | D | Y | S | K | Y | L | D | E* | Q | A | A | K* | E | F | I | Lys(Z10) | W | L | L | Q | T | OH |
| EU-A1681 | 913 | H | Aib | Q | G | T | F | T | S | D | Y | S | K | Y | L | D | E* | Q | A | A | K* | E | F | I | Lys(Z12) | W | L | L | Q | T | OH |
| EU-A1682 | 914 | H | Aib | Q | G | T | F | T | S | D | Y | S | K | Y | L | D | E* | Q | A | A | K* | E | F | I | Lys(Z14) | W | L | L | Q | T | OH |
| EU-A1683 | 915 | H | Aib | Q | G | T | F | T | S | D | Y | S | K | Y | L | D | E* | Q | A | A | K* | E | F | I | Lys(Z16) | W | L | L | Q | T | OH |
| EU-A1684 | 916 | H | Aib | Q | G | T | F | T | S | D | Y | S | K | Y | L | D | E* | Q | A | A | K* | E | F | I | Lys(Z18) | W | L | L | Q | T | OH |
| EU-A1685 | 917 | H | Aib | Q | G | T | F | T | S | D | Y | S | K | Y | L | D | E* | E | A | A | K* | E | F | I | Lys(Z8) | W | L | L | Q | T | OH |
| EU-A1686 | 918 | H | Aib | Q | G | T | F | T | S | D | Y | S | K | Y | L | D | E* | E | A | A | K* | E | F | I | Lys(Z10) | W | L | L | Q | T | OH |
| EU-A1687 | 919 | H | Aib | Q | G | T | F | T | S | D | Y | S | K | Y | L | D | E* | E | A | A | K* | E | F | I | Lys(Z12) | W | L | L | Q | T | OH |
| EU-A1688 | 920 | H | Aib | Q | G | T | F | T | S | D | Y | S | K | Y | L | D | E* | E | A | A | K* | E | F | I | Lys(Z14) | W | L | L | Q | T | OH |
| EU-A1689 | 921 | H | Aib | Q | G | T | F | T | S | D | Y | S | K | Y | L | D | E* | E | A | A | K* | E | F | I | Lys(Z16) | W | L | L | Q | T | OH |
| EU-A1690 | 922 | H | Aib | Q | G | T | F | T | S | D | Y | S | K | Y | L | D | E* | E | A | A | K* | E | F | I | Lys(Z18) | W | L | L | Q | T | OH |
| EU-A1691 | 923 | H | Aib | Q | G | T | F | T | S | D | Y | S | K | Y | L | D | E* | Q | A | A | K* | E | F | I | LysS1(Z8) | W | L | L | Q | T | OH |
| EU-A1692 | 924 | H | Aib | Q | G | T | F | T | S | D | Y | S | K | Y | L | D | E* | Q | A | A | K* | E | F | I | LysS1(Z10) | W | L | L | Q | T | OH |
| EU-A1693 | 925 | H | Aib | Q | G | T | F | T | S | D | Y | S | K | Y | L | D | E* | Q | A | A | K* | E | F | I | LysS1(Z12) | W | L | L | Q | T | OH |
| EU-A1694 | 926 | H | Aib | Q | G | T | F | T | S | D | Y | S | K | Y | L | D | E* | Q | A | A | K* | E | F | I | LysS1(Z14) | W | L | L | Q | T | OH |
| EU-A1695 | 927 | H | Aib | Q | G | T | F | T | S | D | Y | S | K | Y | L | D | E* | Q | A | A | K* | E | F | I | LysS1(Z16) | W | L | L | Q | T | OH |
| EU-A1696 | 928 | H | Aib | Q | G | T | F | T | S | D | Y | S | K | Y | L | D | E* | Q | A | A | K* | E | F | I | LysS1(Z18) | W | L | L | Q | T | OH |
| EU-A1697 | 929 | H | Aib | Q | G | T | F | T | S | D | Y | S | K | Y | L | D | E* | Q | A | A | K* | E | F | I | LysS2(Z8) | W | L | L | Q | T | OH |
| EU-A1698 | 930 | H | Aib | Q | G | T | F | T | S | D | Y | S | K | Y | L | D | E* | Q | A | A | K* | E | F | I | LysS2(Z10) | W | L | L | Q | T | OH |

FIG. 4 (Continued)
Table 4 (Continued)

| | SEQ ID NO | 1 | | | | 5 | | | | | 10 | | | | | 15 | | | | 20 | | | | | | 25 | | | | | 29 | 30 |
|---|---|---|---|---|---|---|---|---|---|---|---|---|---|---|---|---|---|---|---|---|---|---|---|---|---|---|---|---|---|---|---|---|
| EU-A1699 | 931 | H | Alb | Q | G | T | F | T | S | D | Y | S | K | Y | L | D | E* | Q | A | A | K* | E | F | I | LysS2(Z12) | W | L | L | Q | T | OH |
| EU-A1700 | 932 | H | Alb | Q | G | T | F | T | S | D | Y | S | K | Y | L | D | E* | Q | A | A | K* | E | F | I | LysS2(Z14) | W | L | L | Q | T | OH |
| EU-A1701 | 933 | H | Alb | Q | G | T | F | T | S | D | Y | S | K | Y | L | D | E* | Q | A | A | K* | E | F | I | LysS2(Z16) | W | L | L | Q | T | OH |
| EU-A1702 | 934 | H | Alb | Q | G | T | F | T | S | D | Y | S | K | Y | L | D | E* | Q | A | A | K* | E | F | I | LysS2(Z18) | W | L | L | Q | T | OH |
| EU-A1703 | 935 | H | Alb | Q | G | T | F | T | S | D | Y | S | K | Y | L | D | E* | Q | A | A | K* | E | F | I | LysS3(Z8) | W | L | L | Q | T | OH |
| EU-A1704 | 936 | H | Alb | Q | G | T | F | T | S | D | Y | S | K | Y | L | D | E* | Q | A | A | K* | E | F | I | LysS3(Z10) | W | L | L | Q | T | OH |
| EU-A1705 | 937 | H | Alb | Q | G | T | F | T | S | D | Y | S | K | Y | L | D | E* | Q | A | A | K* | E | F | I | LysS3(Z12) | W | L | L | Q | T | OH |
| EU-A1706 | 938 | H | Alb | Q | G | T | F | T | S | D | Y | S | K | Y | L | D | E* | Q | A | A | K* | E | F | I | LysS3(Z14) | W | L | L | Q | T | OH |
| EU-A1707 | 939 | H | Alb | Q | G | T | F | T | S | D | Y | S | K | Y | L | D | E* | Q | A | A | K* | E | F | I | LysS3(Z16) | W | L | L | Q | T | OH |
| EU-A1708 | 940 | H | Alb | Q | G | T | F | T | S | D | Y | S | K | Y | L | D | E* | Q | A | A | K* | E | F | I | LysS3(Z18) | W | L | L | Q | T | OH |
| EU-A1709 | 941 | H | Alb | Q | G | T | F | T | S | D | Y | S | K | Y | L | D | E* | Q | A | A | K* | E | F | I | LysS1(Z8) | W | L | L | Q | T | # |
| EU-A1710 | 942 | H | Alb | Q | G | T | F | T | S | D | Y | S | K | Y | L | D | E* | Q | A | A | K* | E | F | I | LysS1(Z10) | W | L | L | Q | T | # |
| EU-A1711 | 943 | H | Alb | Q | G | T | F | T | S | D | Y | S | K | Y | L | D | E* | Q | A | A | K* | E | F | I | LysS1(Z12) | W | L | L | Q | T | # |
| EU-A1712 | 944 | H | Alb | Q | G | T | F | T | S | D | Y | S | K | Y | L | D | E* | Q | A | A | K* | E | F | I | LysS1(Z14) | W | L | | Q | T | # |
| EU-A1713 | 945 | H | Alb | Q | G | T | F | T | S | D | Y | S | K | Y | L | D | E* | Q | A | A | K* | E | F | I | LysS1(Z16) | W | L | L | Q | T | # |
| EU-A1714 | 946 | H | Alb | Q | G | T | F | T | S | D | Y | S | K | Y | L | D | E* | Q | A | A | K* | E | F | I | LysS1(Z18) | W | L | L | Q | T | # |
| EU-A1715 | 947 | H | Alb | Q | G | T | F | T | S | D | Y | S | K | Y | L | D | E* | Q | A | A | K* | E | F | I | LysS2(Z8) | W | L | L | Q | T | # |
| EU-A1716 | 948 | H | Alb | Q | G | T | F | T | S | D | Y | S | K | Y | L | D | E* | Q | A | A | K* | E | F | I | LysS2(Z10) | W | L | L | Q | T | # |
| EU-A1717 | 949 | H | Alb | Q | G | T | F | T | S | D | Y | S | K | Y | L | D | E* | Q | A | A | K* | E | F | I | LysS2(Z12) | W | L | L | Q | T | # |
| EU-A1718 | 950 | H | Alb | Q | G | T | F | T | S | D | Y | S | K | Y | L | D | E* | Q | A | A | K* | E | F | I | LysS2(Z14) | W | L | L | Q | T | # |
| EU-A1719 | 951 | H | Alb | Q | G | T | F | T | S | D | Y | S | K | Y | L | D | E* | Q | A | A | K* | E | F | I | LysS2(Z16) | W | L | L | Q | T | # |

FIG. 4 (Continued)
Table 4 (Continued)

| SEQ ID NO | | 1 | | | | 5 | | | | | 10 | | | | | 15 | | | | 20 | | | | | 25 | | | | | 29 | 30 |
|---|---|---|---|---|---|---|---|---|---|---|---|---|---|---|---|---|---|---|---|---|---|---|---|---|---|---|---|---|---|---|---|
| 952 | EU-A1720 | H | Aib | Q | G | T | F | T | S | D | Y | S | K | Y | L | D | E* | Q | A | A | K* | E | F | LysS2(Z18) | W | L | L | Q | T | # |
| 953 | EU-A1721 | H | Aib | Q | G | T | F | T | S | D | Y | S | K | Y | L | D | E* | Q | A | A | K* | E | F | LysS3(Z8) | W | L | L | Q | T | # |
| 954 | EU-A1722 | H | Aib | Q | G | T | F | T | S | D | Y | S | K | Y | L | D | E* | Q | A | A | K* | E | F | LysS3(Z10) | W | L | L | Q | T | # |
| 955 | EU-A1723 | H | Aib | Q | G | T | F | T | S | D | Y | S | K | Y | L | D | E* | Q | A | A | K* | E | F | LysS3(Z12) | W | L | L | Q | T | # |
| 956 | EU-A1724 | H | Aib | Q | G | T | F | T | S | D | Y | S | K | Y | L | D | E* | Q | A | A | K* | E | F | LysS3(Z14) | W | L | L | Q | T | # |
| 957 | EU-A1725 | H | Aib | Q | G | T | F | T | S | D | Y | S | K | Y | L | D | E* | Q | A | A | K* | E | F | LysS3(Z16) | W | L | L | Q | T | # |
| 958 | EU-A1726 | H | Aib | Q | G | T | F | T | S | D | Y | S | K | Y | L | D | E* | Q | A | A | K* | E | F | LysS3(Z18) | W | L | L | Q | T | # |
| 959 | EU-A1727 | H | Aib | Q | G | T | F | T | S | D | E* | S | K | Y | K* | D | S | Q | A | A | Lys(Me10) | E | F | Q | W | L | L | Q | T | # |
| 960 | EU-A1728 | H | Aib | Q | G | T | F | T | S | D | E* | S | K | Y | K* | D | S | Q | A | A | Lys(Me12) | E | F | Q | W | L | L | Q | T | # |
| 961 | EU-A1729 | H | Aib | Q | G | T | F | T | S | D | E* | S | K | Y | K* | D | S | Q | A | A | Lys(Me14) | E | F | Q | W | L | L | Q | T | # |
| 962 | EU-A1730 | H | Aib | Q | G | T | F | T | S | D | E* | S | K | Y | K* | D | S | Q | A | A | Lys(Me16) | E | F | Q | W | L | L | Q | T | # |
| 963 | EU-A1731 | H | Aib | Q | G | T | F | T | S | D | E* | S | K | Y | K* | D | S | Q | A | A | Lys(Me18) | E | F | Q | W | L | L | Q | T | # |
| 964 | EU-A1732 | H | Aib | Q | G | T | F | T | S | D | E* | S | K | Y | K* | D | S | Q | A | A | Lys(Z10) | E | F | Q | W | L | L | Q | T | # |
| 965 | EU-A1733 | H | Aib | Q | G | T | F | T | S | D | E* | S | K | Y | K* | D | S | Q | A | A | Lys(Z12) | E | F | Q | W | L | L | Q | T | # |
| 966 | EU-A1734 | H | Aib | Q | G | T | F | T | S | D | E* | S | K | Y | K* | D | S | Q | A | A | Lys(Z14) | E | F | Q | W | L | L | Q | T | # |
| 967 | EU-A1735 | H | Aib | Q | G | T | F | T | S | D | E* | S | K | Y | K* | D | S | Q | A | A | Lys(Z16) | E | F | Q | W | L | L | Q | T | # |
| 968 | EU-A1736 | H | Aib | Q | G | T | F | T | S | D | E* | S | K | Y | K* | D | S | Q | A | A | Lys(Z18) | E | F | Q | W | L | L | Q | T | # |
| 969 | EU-A1737 | H | Aib | Q | G | T | F | T | S | D | Y | S | E* | Y | L | D | K* | Q | A | A | Lys(Me10) | E | F | Q | W | L | L | Q | T | # |
| 970 | EU-A1738 | H | Aib | Q | G | T | F | T | S | D | Y | S | E* | Y | L | D | K* | Q | A | A | Lys(Me12) | E | F | Q | W | L | L | Q | T | # |
| 971 | EU-A1739 | H | Aib | Q | G | T | F | T | S | D | Y | S | E* | Y | L | D | K* | Q | A | A | Lys(Me14) | E | F | Q | W | L | L | Q | T | # |
| 972 | EU-A1740 | H | Aib | Q | G | T | F | T | S | D | Y | S | E* | Y | L | D | K* | Q | A | A | Lys(Me16) | E | F | Q | W | L | L | Q | T | # |

FIG. 4 (Continued)
Table 4 (Continued)

| EU-A | SEQ ID NO | 1 | 2 | 3 | 4 | 5 | 6 | 7 | 8 | 9 | 10 | 11 | 12 | 13 | 14 | 15 | 16 | 17 | 18 | 19 | 20 | 21 | 22 | 23 | 24 | 25 | 26 | 27 | 28 | 29 | 30 |
|---|---|---|---|---|---|---|---|---|---|---|---|---|---|---|---|---|---|---|---|---|---|---|---|---|---|---|---|---|---|---|---|
| EU-A1741 | 973 | H | Aib | Q | G | T | F | T | S | D | Y | S | E* | Y | L | D | K* |  | A | A | Lys(Me18) | E | F |  |  | W | L | L | Q | T | # |
| EU-A1742 | 974 | H | Aib | Q | G | T | F | T | S | D | Y | S | E* | Y | L | D | K* | Q | A | A | Lys(Z10) | E | F | — | Q | W | L | L | Q | T | # |
| EU-A1743 | 975 | H | Aib | Q | G | T | F | T | S | D | Y | S | E* | Y | L | D | K* | Q | A | A | Lys(Z12) | E | F | — | Q | W | L | L | Q | T | # |
| EU-A1744 | 976 | H | Aib | Q | G | T | F | T | S | D | Y | S | E* | Y | L | D | K* | Q | A | A | Lys(Z14) | E | F | — | Q | W | L | L | Q | T | # |
| EU-A1745 | 977 | H | Aib | Q | G | T | F | T | S | D | Y | S | E* | Y | L | D | K* | Q | A | A | Lys(Z16) | E | F | — | Q | W | L | L | Q | T | # |
| EU-A1746 | 978 | H | Aib | Q | G | T | F | T | S | D | Y | S | E* | Y | L | D | K* | Q | A | A | Lys(Z18) | E | F | — | Q | W | L | L | Q | T | # |
| EU-A1747 | 979 | H | Aib | Q | G | T | F | T | S | D | E* | S | K | Y | K* | D | S | Q | A | A | LysS1(Me10) | E | F | — | Q | W | L | L | Q | T | # |
| EU-A1748 | 980 | H | Aib | Q | G | T | F | T | S | D | E* | S | K | Y | K* | D | S | Q | A | A | LysS1(Me12) | E | F | — | Q | W | L | L | Q | T | # |
| EU-A1749 | 981 | H | Aib | Q | G | T | F | T | S | D | E* | S | K | Y | K* | D | S | Q | A | A | LysS1(Me14) | E | F | — | Q | W | L | L | Q | T | # |
| EU-A1750 | 982 | H | Aib | Q | G | T | F | T | S | D | E* | S | K | Y | K* | D | S | Q | A | A | LysS1(Me16) | E | F | — | Q | W | L | L | Q | T | # |
| EU-A1751 | 983 | H | Aib | Q | G | T | F | T | S | D | E* | S | K | Y | K* | D | S | Q | A | A | LysS1(Me18) | E | F | — | Q | W | L | L | Q | T | # |
| EU-A1752 | 984 | H | Aib | Q | G | T | F | T | S | D | E* | S | K | Y | K* | D | S | Q | A | A | LysS2(Me10) | E | F | — | Q | W | L | L | Q | T | # |
| EU-A1753 | 985 | H | Aib | Q | G | T | F | T | S | D | E* | S | K | Y | K* | D | S | Q | A | A | LysS2(Me12) | E | F | — | Q | W | L | L | Q | T | # |
| EU-A1754 | 986 | H | Aib | Q | G | T | F | T | S | D | E* | S | K | Y | K* | D | S | Q | A | A | LysS3(Me14) | E | F | — | Q | W | L | L | Q | T | # |
| EU-A1755 | 987 | H | Aib | Q | G | T | F | T | S | D | E* | S | K | Y | K* | D | S | Q | A | A | LysS3(Me16) | E | F | — | Q | W | L | L | Q | T | # |
| EU-A1756 | 988 | H | Aib | Q | G | T | F | T | S | D | E* | S | K | Y | K* | D | S | Q | A | A | LysS2(Me18) | E | F | — | Q | W | L | L | Q | T | # |
| EU-A1757 | 989 | H | Aib | Q | G | T | F | T | S | D | E* | S | K | Y | K* | D | S | Q | A | A | LysS2(Me14) | E | F | — | Q | W | L | L | Q | T | # |
| EU-A1758 | 990 | H | Aib | Q | G | T | F | T | S | D | E* | S | K | Y | K* | D | S | Q | A | A | LysS2(Me16) | E | F | — | Q | W | L | L | Q | T | # |
| EU-A1759 | 991 | H | Aib | Q | G | T | F | T | S | D | E* | S | K | Y | K* | D | S | Q | A | A | LysS1(Z10) | E | F | — | Q | W | L | L | Q | T | # |
| EU-A1760 | 992 | H | Aib | Q | G | T | F | T | S | D | E* | S | K | Y | K* | D | S | Q | A | A | LysS1(Z12) | E | F | — | Q | W | L | L | Q | T | # |
| EU-A1761 | 993 | H | Aib | Q | G | T | F | T | S | D | E* | S | K | Y | K* | D | S | Q | A | A | LysS1(Z14) | E | F | — | Q | W | L | L | Q | T | # |

FIG. 4 (Continued)
Table 4 (Continued)

| | SEQ ID NO | 1 | | | | 5 | | | | | 10 | | | | | 15 | | | | | 20 | | | | 25 | | | | | 29 | 30 |
|---|---|---|---|---|---|---|---|---|---|---|---|---|---|---|---|---|---|---|---|---|---|---|---|---|---|---|---|---|---|---|---|
| EU-A1762 | 994 | H | Aib | Q | G | T | F | T | S | D | Ë* | S | K | Y | K* | D | S | Q | A | A | LysS1(Z16) | E | F | I | Q | W | L | L | Q | T | # |
| EU-A1763 | 995 | H | Aib | Q | G | T | F | T | S | D | Ë* | S | K | Y | K* | D | S | Q | A | A | LysS1(Z18) | E | F | I | Q | W | L | L | Q | T | # |
| EU-A1764 | 996 | H | Aib | Q | G | T | F | T | S | D | Ë* | S | K | Y | K* | D | S | Q | A | A | LysS2(Z14) | E | F | I | Q | W | L | L | Q | T | # |
| EU-A1765 | 997 | H | Aib | Q | G | T | F | T | S | D | Ë* | S | K | Y | K* | D | S | Q | A | A | LysS2(Z16) | E | F | I | Q | W | L | L | Q | T | # |
| EU-A1766 | 998 | H | Aib | Q | G | T | F | T | S | D | Ë* | S | K | Y | K* | D | S | Q | A | A | LysS2(Z18) | E | F | I | Q | W | L | L | Q | T | # |
| EU-A1767 | 999 | H | Aib | Q | G | T | F | T | S | D | Ë* | S | K | Y | K* | D | S | Q | A | A | LysS3(Z14) | E | F | I | Q | W | L | L | Q | T | # |
| EU-A1768 | 1000 | H | Aib | Q | G | T | F | T | S | D | Ë* | S | K | Y | K* | D | S | Q | A | A | LysS3(Z16) | E | F | I | Q | W | L | L | Q | T | # |
| EU-A1769 | 1001 | H | Aib | Q | G | T | F | T | S | D | Ë* | S | K | Y | K* | D | S | Q | A | A | LysS3(Z18) | E | F | I | Q | W | L | L | Q | T | # |
| EU-A1770 | 1002 | H | Aib | Q | G | T | F | T | S | D | Y | S | Ë* | Y | L | D | K* | Q | A | A | LysS1(Me10) | E | F | I | Q | W | L | L | Q | T | # |
| EU-A1771 | 1003 | H | Aib | Q | G | T | F | T | S | D | Y | S | Ë* | Y | L | D | K* | Q | A | A | LysS1(Me12) | E | F | I | Q | W | L | L | Q | T | # |
| EU-A1772 | 1004 | H | Aib | Q | G | T | F | T | S | D | Y | S | Ë* | Y | L | D | K* | Q | A | A | LysS1(Me14) | E | F | I | Q | W | L | L | Q | T | # |
| EU-A1773 | 1005 | H | Aib | Q | G | T | F | T | S | D | Y | S | Ë* | Y | L | D | K* | Q | A | A | LysS1(Me16) | E | F | I | Q | W | L | L | Q | T | # |
| EU-A1774 | 1006 | H | Aib | Q | G | T | F | T | S | D | Y | S | Ë* | Y | L | D | K* | Q | A | A | LysS1(Me18) | E | F | I | Q | W | L | L | Q | T | # |
| EU-A1775 | 1007 | H | Aib | Q | G | T | F | T | S | D | Y | S | Ë* | Y | L | D | K* | Q | A | A | LysS2(Me10) | E | F | I | Q | W | L | L | Q | T | # |
| EU-A1776 | 1008 | H | Aib | Q | G | T | F | T | S | D | Y | S | Ë* | Y | L | D | K* | Q | A | A | LysS2(Me12) | E | F | I | Q | W | L | L | Q | T | # |
| EU-A1777 | 1009 | H | Aib | Q | G | T | F | T | S | D | Y | S | Ë* | Y | L | D | K* | Q | A | A | LysS3(Me14) | E | F | I | Q | W | L | L | Q | T | # |
| EU-A1778 | 1010 | H | Aib | Q | G | T | F | T | S | D | Y | S | Ë* | Y | L | D | K* | Q | A | A | LysS3(Me16) | E | F | I | Q | W | L | L | Q | T | # |
| EU-A1779 | 1011 | H | Aib | Q | G | T | F | T | S | D | Y | S | Ë* | Y | L | D | K* | Q | A | A | LysS3(Me18) | E | F | I | Q | W | L | L | Q | T | # |
| EU-A1780 | 1012 | H | Aib | Q | G | T | F | T | S | D | Y | S | Ë* | Y | L | D | K* | Q | A | A | LysS2(Me14) | E | F | I | Q | W | L | L | Q | T | # |
| EU-A1781 | 1013 | H | Aib | Q | G | T | F | T | S | D | Y | S | Ë* | Y | L | D | K* | Q | A | A | LysS2(Me16) | E | F | I | Q | W | L | L | Q | T | # |
| EU-A1782 | 1014 | H | Aib | Q | G | T | F | T | S | D | Y | S | Ë* | Y | L | D | K* | Q | A | A | LysS1(Z10) | E | F | I | Q | W | L | L | Q | T | # |

FIG. 4 (Continued)
Table 4 (Continued)

| | 1 | | | | 5 | | | | | 10 | | | | | 15 | | | | | 20 | | | | | 25 | | | | | 29 | 30 |
|---|---|---|---|---|---|---|---|---|---|---|---|---|---|---|---|---|---|---|---|---|---|---|---|---|---|---|---|---|---|---|
| SEQ ID NO | | | | | | | | | | | | | | | | | | | | | | | | | | | | | | |
| EU-A1783 | 1015 | H | Alb | Q | G | T | F | T | S | D | Y | S | E* | Y | L | D | K* | | Q | | A | A | LysS1(Z12) | E | F | | Q | W | L | L | Q | T | # |
| EU-A1784 | 1016 | H | Alb | Q | G | T | F | T | S | D | Y | S | E* | Y | L | D | K* | | Q | | A | A | LysS1(Z14) | E | F | | Q | W | L | L | Q | T | # |
| EU-A1785 | 1017 | H | Alb | Q | G | T | F | T | S | D | Y | S | E* | Y | L | D | K* | | Q | | A | A | LysS1(Z16) | E | F | | Q | W | L | L | Q | T | # |
| EU-A1786 | 1018 | H | Alb | Q | G | T | F | T | S | D | Y | S | E* | Y | L | D | K* | | Q | | A | A | LysS1(Z18) | E | F | | Q | W | L | L | Q | T | # |
| EU-A1787 | 1019 | H | Alb | Q | G | T | F | T | S | D | Y | S | E* | Y | L | D | K* | | Q | | A | A | LysS2(Z14) | E | F | | Q | W | L | L | Q | T | # |
| EU-A1788 | 1020 | H | Alb | Q | G | T | F | T | S | D | Y | S | E* | Y | L | D | K* | | Q | | A | A | LysS2(Z16) | E | F | | Q | W | L | L | Q | T | # |
| EU-A1789 | 1021 | H | Alb | Q | G | T | F | T | S | D | Y | S | E* | Y | L | D | K* | | Q | | A | A | LysS2(Z18) | E | F | | Q | W | L | L | Q | T | # |
| EU-A1790 | 1022 | H | Alb | Q | G | T | F | T | S | D | Y | S | E* | Y | L | D | K* | | Q | | A | A | LysS3(Z14) | E | F | | Q | W | L | L | Q | T | # |
| EU-A1791 | 1023 | H | Alb | Q | G | T | F | T | S | D | Y | S | E* | Y | L | D | K* | | Q | | A | A | LysS3(Z16) | E | F | | Q | W | L | L | Q | T | # |
| EU-A1792 | 1024 | H | Alb | Q | G | T | F | T | S | D | Y | S | E* | Y | L | D | K* | | Q | | A | A | LysS3(Z18) | E | F | | Q | W | L | L | Q | T | # |
| EU-A1793 | 1030 | H | Alb | Q | G | T | F | T | S | D | Y | S | K | Y | L | D | E* | LysS1(Me10) | | | A | A | K* | E | F | | Q | W | L | L | Q | T | # |
| EU-A1794 | 1031 | H | Alb | Q | G | T | F | T | S | D | Y | S | K | Y | L | D | E* | LysS1(Me12) | | | A | A | K* | E | F | | Q | W | L | L | Q | T | # |
| EU-A1795 | 1032 | H | Alb | Q | G | T | F | T | S | D | Y | S | K | Y | L | D | E* | LysS1(Me14) | | | A | A | K* | E | F | | Q | W | L | L | Q | T | # |
| EU-A1796 | 1033 | H | Alb | Q | G | T | F | T | S | D | Y | S | K | Y | L | D | E* | LysS1(Me16) | | | A | A | K* | E | F | | Q | W | L | L | Q | T | # |
| EU-A1797 | 1034 | H | Alb | Q | G | T | F | T | S | D | Y | S | K | Y | L | D | E* | LysS1(Me18) | | | A | A | K* | E | F | | Q | W | L | L | Q | T | # |
| EU-A1798 | 1035 | H | Alb | Q | G | T | F | T | S | D | Y | S | K | Y | L | D | E* | LysS1(Me14) | | | A | A | K* | E | F | | Q | W | L | L | Q | T | # |
| EU-A1799 | 1036 | H | Alb | Q | G | T | F | T | S | D | Y | S | K | Y | L | D | E* | LysS1(Me16) | | | A | A | K* | E | F | | Q | W | L | L | Q | T | # |
| EU-A1800 | 1037 | H | Alb | Q | G | T | F | T | S | D | Y | S | K | Y | L | D | E* | LysS1(Me18) | | | A | A | K* | E | F | | E | W | L | L | Q | T | # |
| EU-A1801 | 1038 | H | Alb | Q | G | T | F | T | S | D | Y | S | K | Y | L | D | E* | LysS2(Me10) | | | A | A | K* | E | F | | Q | W | L | L | Q | T | # |
| EU-A1802 | 1039 | H | Alb | Q | G | T | F | T | S | D | Y | S | K | Y | L | D | E* | LysS2(Me12) | | | A | A | K* | E | F | | Q | W | L | L | Q | T | # |
| EU-A1803 | 1040 | H | Alb | Q | G | T | F | T | S | D | Y | S | K | Y | L | D | E* | LysS2(Me14) | | | A | A | K* | E | F | | Q | W | L | L | Q | T | # |

FIG. 4 (Continued)
Table 4 (Continued)

| SEQ ID NO | 1 | | | | 5 | | | | | 10 | | | | | 15 | | | | | 20 | | | | | 25 | | | | | 29 | 30 |
|---|---|---|---|---|---|---|---|---|---|---|---|---|---|---|---|---|---|---|---|---|---|---|---|---|---|---|---|---|---|---|---|
| 1041 | H | Alb | Q | G | T | F | T | S | D | Y | S | K | Y | L | D | E* | LysS2(Me16) | A | A | K* | E | F | Q | | W | L | L | Q | T | # | EU-A1804 |
| 1042 | H | Alb | Q | G | T | F | T | S | D | Y | S | K | Y | L | D | E* | LysS2(Me18) | A | A | K* | E | F | Q | | W | L | L | Q | T | # | EU-A1805 |
| 1043 | H | Alb | Q | G | T | F | T | S | D | Y | S | K | Y | L | D | E* | LysS2(Me14) | A | A | K* | E | F | E | | W | L | L | Q | T | # | EU-A1806 |
| 1044 | H | Alb | Q | G | T | F | T | S | D | Y | S | K | Y | L | D | E* | LysS2(Me16) | A | A | K* | E | F | E | | W | L | L | Q | T | # | EU-A1807 |
| 1045 | H | Alb | Q | G | T | F | T | S | D | Y | S | K | Y | L | D | E* | LysS2(Me18) | A | A | K* | E | F | E | | W | L | L | Q | T | # | EU-A1808 |
| 1046 | H | Alb | Q | G | T | F | T | S | D | Y | S | K | Y | L | D | E* | LysS3(Me10) | A | A | K* | E | F | Q | | W | L | L | Q | T | # | EU-A1809 |
| 1047 | H | Alb | Q | G | T | F | T | S | D | Y | S | K | Y | L | D | E* | LysS3(Me12) | A | A | K* | E | F | Q | | W | L | L | Q | T | # | EU-A1810 |
| 1048 | H | Alb | Q | G | T | F | T | S | D | Y | S | K | Y | L | D | E* | LysS3(Me14) | A | A | K* | E | F | Q | | W | L | L | Q | T | # | EU-A1811 |
| 1049 | H | Alb | Q | G | T | F | T | S | D | Y | S | K | Y | L | D | E* | LysS3(Me16) | A | A | K* | E | F | Q | | W | L | L | Q | T | # | EU-A1812 |
| 1050 | H | Alb | Q | G | T | F | T | S | D | Y | S | K | Y | L | D | E* | LysS3(Me18) | A | A | K* | E | F | E | | W | L | L | Q | T | # | EU-A1813 |
| 1051 | H | Alb | Q | G | T | F | T | S | D | Y | S | K | Y | L | D | E* | LysS3(Me14) | A | A | K* | E | F | E | | W | L | L | Q | T | # | EU-A1814 |
| 1052 | H | Alb | Q | G | T | F | T | S | D | Y | S | K | Y | L | D | E* | LysS3(Me16) | A | A | K* | E | F | E | | W | L | L | Q | T | # | EU-A1815 |
| 1053 | H | Alb | Q | G | T | F | T | S | D | Y | S | K | Y | L | D | E* | LysS3(Me18) | A | A | K* | E | F | E | | W | L | L | Q | T | # | EU-A1816 |
| 1054 | H | Alb | Q | G | T | F | T | S | D | Y | S | K | Y | L | D | E* | LysS1(Z10) | A | A | K* | E | F | Q | | W | L | L | Q | T | # | EU-A1817 |
| 1055 | H | Alb | Q | G | T | F | T | S | D | Y | S | K | Y | L | D | E* | LysS1(Z12) | A | A | K* | E | F | Q | | W | L | L | Q | T | # | EU-A1818 |
| 1056 | H | Alb | Q | G | T | F | T | S | D | Y | S | K | Y | L | D | E* | LysS1(Z14) | A | A | K* | E | F | Q | | W | L | L | Q | T | # | EU-A1819 |
| 1057 | H | Alb | Q | G | T | F | T | S | D | Y | S | K | Y | L | D | E* | LysS1(Z16) | A | A | K* | E | F | Q | | W | L | L | Q | T | # | EU-A1820 |
| 1058 | H | Alb | Q | G | T | F | T | S | D | Y | S | K | Y | L | D | E* | LysS1(Z18) | A | A | K* | E | F | E | | W | L | L | Q | T | # | EU-A1821 |
| 1059 | H | Alb | Q | G | T | F | T | S | D | Y | S | K | Y | L | D | E* | LysS1(Z16) | A | A | K* | E | F | E | | W | L | L | Q | T | # | EU-A1822 |
| 1060 | H | Alb | Q | G | T | F | T | S | D | Y | S | K | Y | L | D | E* | LysS1(Z18) | A | A | K* | E | F | E | | W | L | L | Q | T | # | EU-A1823 |
| 1061 | H | Alb | Q | G | T | F | T | S | D | Y | S | K | Y | L | D | E* | LysS2(Z10) | A | A | K* | E | F | Q | | W | L | L | Q | T | # | EU-A1824 |

FIG. 4 (Continued)
Table 4 (Continued)

| SEQ ID NO | 1 | | | | 5 | | | | | 10 | | | | | 15 | | | | | 20 | | | | | 25 | | | | | 29 | 30 |
|---|---|---|---|---|---|---|---|---|---|---|---|---|---|---|---|---|---|---|---|---|---|---|---|---|---|---|---|---|---|---|---|
| 1062 | H | Aib | Q | G | T | F | T | S | D | Y | S | K | Y | L | D | E* | LysS2(Z12) | A | A | K* | E | F | I | | W | L | L | Q | T | # |
| 1063 | H | Aib | Q | G | T | F | T | S | D | Y | S | K | Y | L | D | E* | LysS2(Z14) | A | A | K* | E | F | I | Q | W | L | L | Q | T | # |
| 1064 | H | Aib | Q | G | T | F | T | S | D | Y | S | K | Y | L | D | E* | LysS2(Z16) | A | A | K* | E | F | I | Q | W | L | L | Q | T | # |
| 1065 | H | Aib | Q | G | T | F | T | S | D | Y | S | K | Y | L | D | E* | LysS2(Z18) | A | A | K* | E | F | I | Q | W | L | L | Q | T | # |
| 1066 | H | Aib | Q | G | T | F | T | S | D | Y | S | K | Y | L | D | E* | LysS2(Z16) | A | A | K* | E | F | I | Q | W | L | L | Q | T | # |
| 1067 | H | Aib | Q | G | T | F | T | S | D | Y | S | K | Y | L | D | E* | LysS3(Z10) | A | A | K* | E | F | I | E | W | L | L | Q | T | # |
| 1068 | H | Aib | Q | G | T | F | T | S | D | Y | S | K | Y | L | D | E* | LysS3(Z12) | A | A | K* | E | F | I | E | W | L | L | Q | T | # |
| 1069 | H | Aib | Q | G | T | F | T | S | D | Y | S | K | Y | L | D | E* | LysS3(Z14) | A | A | K* | E | F | I | Q | W | L | L | Q | T | # |
| 1070 | H | Aib | Q | G | T | F | T | S | D | Y | S | K | Y | L | D | E* | LysS3(Z16) | A | A | K* | E | F | I | Q | W | L | L | Q | T | # |
| 1071 | H | Aib | Q | G | T | F | T | S | D | Y | S | K | Y | L | D | E* | LysS3(Z18) | A | A | K* | E | F | I | Q | W | L | L | Q | T | # |
| 1072 | H | Aib | Q | G | T | F | T | S | D | Y | S | K | Y | L | D | E* | LysS3(Z16) | A | A | K* | E | F | I | Q | W | L | L | Q | T | # |
| 1073 | H | Aib | Q | G | T | F | T | S | D | Y | S | K | Y | L | D | E* | Lys(Me14) | A | A | K* | E | F | I | E | W | L | L | Q | T | # |
| 1074 | H | Aib | Q | G | T | F | T | S | D | Y | S | K | Y | L | D | E* | Lys(Me16) | A | A | K* | E | F | I | E | W | L | L | Q | T | # |
| 1075 | H | Aib | Q | G | T | F | T | S | D | Y | S | K | Y | L | D | E* | Lys(Me18) | A | A | K* | E | F | I | E | W | L | L | Q | T | # |
| 1076 | H | Aib | Q | G | T | F | T | S | D | Y | S | K | Y | L | D | E* | Lys(Z14) | A | A | K* | E | F | I | E | W | L | L | Q | T | # |
| 1077 | H | Aib | Q | G | T | F | T | S | D | Y | S | K | Y | L | D | E* | Lys(Z16) | A | A | K* | E | F | I | E | W | L | L | Q | T | # |
| 1078 | H | Aib | Q | G | T | F | T | S | D | Y | S | K | Y | L | D | E* | Lys(Z18) | A | A | K* | E | F | I | E | W | L | L | Q | T | # |
| 1079 | H | Aib | Q | G | T | F | T | S | D | Y | E* | S | K | K* | D | S | Q | A | A | Lys(Me14) | E | F | I | E | W | L | L | Q | T | # |
| 1080 | H | Aib | Q | G | T | F | T | S | D | Y | E* | S | K | K* | D | S | Q | A | A | Lys(Me16) | E | F | I | E | W | L | L | Q | T | # |

EU-A1825
EU-A1826
EU-A1827
EU-A1828
EU-A1829
EU-A1830
EU-A1831
EU-A1832
EU-A1833
EU-A1834
EU-A1835
EU-A1836
EU-A1837
EU-A1838
EU-A1839
EU-A1840
EU-A1841
EU-A1842
EU-A1843
EU-A1844
EU-A1845

FIG. 4 (Continued)
Table 4 (Continued)

| | SEQ ID NO | 1 | | | | 5 | | | | | 10 | | | | | 15 | | | | | 20 | | | | | 25 | | | | 29 | 30 |
|---|---|---|---|---|---|---|---|---|---|---|---|---|---|---|---|---|---|---|---|---|---|---|---|---|---|---|---|---|---|---|---|
| EU-A1846 | 1083 | H | Alb | Q | G | T | F | T | S | D | E* | S | K | Y | K* | D | S | | A | A | Lys(Me18) | E | F | I | E | W | L | L | Q | T | # |
| EU-A1847 | 1084 | H | Alb | Q | G | T | F | T | S | D | E* | S | K | Y | K* | D | S | Q | A | A | Lys(Z14) | E | F | I | E | W | L | L | Q | T | # |
| EU-A1848 | 1085 | H | Alb | Q | G | T | F | T | S | D | E* | S | K | Y | K* | D | S | Q | A | A | Lys(Z16) | E | F | I | E | W | L | L | Q | T | # |
| EU-A1849 | 1086 | H | Alb | Q | G | T | F | T | S | D | E* | S | K | Y | K* | D | S | Q | A | A | Lys(Z18) | E | F | I | E | W | L | L | Q | T | # |
| EU-A1850 | 1087 | H | Alb | Q | G | T | F | T | S | D | E* | S | K | Y | K* | D | S | E | A | A | Lys(Me14) | E | F | I | E | W | L | L | Q | T | # |
| EU-A1851 | 1088 | H | Alb | Q | G | T | F | T | S | D | E* | S | K | Y | K* | D | S | E | A | A | Lys(Me16) | E | F | I | E | W | L | L | Q | T | # |
| EU-A1852 | 1089 | H | Alb | Q | G | T | F | T | S | D | E* | S | K | Y | K* | D | S | E | A | A | Lys(Me18) | E | F | I | E | W | L | L | Q | T | # |
| EU-A1853 | 1090 | H | Alb | Q | G | T | F | T | S | D | E* | S | K | Y | K* | D | S | E | A | A | Lys(Z14) | E | F | I | E | W | L | L | Q | T | # |
| EU-A1854 | 1091 | H | Alb | Q | G | T | F | T | S | D | E* | S | K | Y | K* | D | S | E | A | A | Lys(Z16) | E | F | I | E | W | L | L | Q | T | # |
| EU-A1855 | 1092 | H | Alb | Q | G | T | F | T | S | D | E* | S | K | Y | K* | D | S | E | A | A | Lys(Z18) | E | F | I | E | W | L | L | Q | T | # |
| EU-A1856 | 1093 | H | Alb | Q | G | T | F | T | S | D | E* | S | K | Y | K* | D | S | E | A | A | Lys(Me14) | E | F | I | Q | W | L | L | Q | T | # |
| EU-A1857 | 1094 | H | Alb | Q | G | T | F | T | S | D | E* | S | K | Y | K* | D | S | E | A | A | Lys(Me16) | E | F | I | Q | W | L | L | Q | T | # |
| EU-A1858 | 1095 | H | Alb | Q | G | T | F | T | S | D | E* | S | K | Y | K* | D | S | E | A | A | Lys(Me18) | E | F | I | Q | W | L | L | Q | T | # |
| EU-A1859 | 1096 | H | Alb | Q | G | T | F | T | S | D | E* | S | K | Y | K* | D | S | E | A | A | Lys(Z14) | E | F | I | Q | W | L | L | Q | T | # |
| EU-A1860 | 1097 | H | Alb | Q | G | T | F | T | S | D | E* | S | K | Y | K* | D | S | E | A | A | Lys(Z16) | E | F | I | Q | W | L | L | Q | T | # |
| EU-A1861 | 1098 | H | Alb | Q | G | T | F | T | S | D | E* | S | K | Y | K* | D | S | E | A | A | Lys(Z18) | E | F | I | Q | W | L | L | Q | T | # |
| EU-A1862 | 1099 | H | Alb | Q | G | T | F | T | S | D | E* | S | K | Y | K* | D | S | Lys(Z12) | A | A | Gln | E | F | I | Lys(Z12) | W | L | L | Q | T | # |
| EU-A1863 | 1100 | H | Alb | Q | G | T | F | T | S | D | E* | S | K | Y | K* | D | S | Lys(Z14) | A | A | Gln | E | F | I | Lys(Z14) | W | L | L | Q | T | # |
| EU-A1864 | 1101 | H | Alb | Q | G | T | F | T | S | D | E* | S | K | Y | K* | D | S | Lys(Z16) | A | A | Gln | E | F | I | Lys(Z16) | W | L | L | Q | T | # |
| EU-A1865 | 1102 | H | Alb | Q | G | T | F | T | S | D | E* | S | K | Y | K* | D | S | Lys(Z14CO2) | A | A | Gln | E | F | I | Q | W | L | L | Q | T | # |
| EU-A1866 | 1103 | H | Alb | Q | G | T | F | T | S | D | E* | S | K | Y | K* | D | S | Lys(Z16CO2) | A | A | Gln | E | F | I | Q | W | L | L | Q | T | # |

FIG. 4 (Continued)
Table 4 (Continued)

| SEQ ID NO | 1 | | | | 5 | | | | | 10 | | | | | 15 | | | | | 20 | | | | | 25 | | | | 29 | 30 |
|---|---|---|---|---|---|---|---|---|---|---|---|---|---|---|---|---|---|---|---|---|---|---|---|---|---|---|---|---|---|---|
| EU-A1867 | 1104 | H | Aib | Q | G | T | F | T | S | D | E* | S | K | Y | K* | D | S | Lys(Z18CO$_2$) | A | A | Gln | E | F | I | Q | W | L | L | Q | T | # |
| EU-A1868 | 1105 | H | Aib | Q | G | T | F | T | S | D | E* | S | K | Y | K* | D | S | Gln | A | A | Gln | E | F | I | Lys(Z14CO$_2$) | W | L | L | Q | T | # |
| EU-A1869 | 1106 | H | Aib | Q | G | T | F | T | S | D | E* | S | K | Y | K* | D | S | Gln | A | A | Gln | E | F | I | Lys(Z16CO$_2$) | W | L | L | Q | T | # |
| EU-A1870 | 1107 | H | Aib | Q | G | T | F | T | S | D | E* | S | K | Y | K* | D | S | Gln | A | A | Gln | E | F | I | Lys(Z18CO$_2$) | W | L | L | Q | T | # |

The substitution on Lys in the peptide sequence is represented by a letter designation of the surfactant-derived X (Z means glucoside-derived; Me means melibioside-derived; M means maltoside-derived) with a number designating the alkyl substitution. Thus, for example, Lys(Me12) is Lys(N-epsilon linked beta-D-melibiouronyl) and Lys(Z12) is Lys(N-epsilon linked 1-dodecyl beta-D-glucuronyl).

Z18CO$_2$ denotes 1-(17-carboxyheptadecyl) beta-D-glucuronyl.

OH is carboxyl and # is amide.

LysS1(Me12) is lysine with an epsilon linked spacer, for S1 that is alpha linked lysine with epsilon linked Me12.

S2 is a gamma-Glu linker like in liraglutide, S3 is a gamma-glu-gamma glu. PEGa is amino-dPEG4-OH, PEGb, dPEG8-OH.

PEGc is corresponding amido dPEG4-NH2 and PEGd is amido dPEG8-NH2.

The pair of amino acids E*, K* separated by 4 residues denotes a side chain lactam linkage formed between the side chain functional groups on these amino acids.

H-His¹-Aib-Gln-Gly-Thr-Phe-Thr-Ser-Asp-Tyr¹⁰-Ser-Lys-Tyr-Leu-Asp-

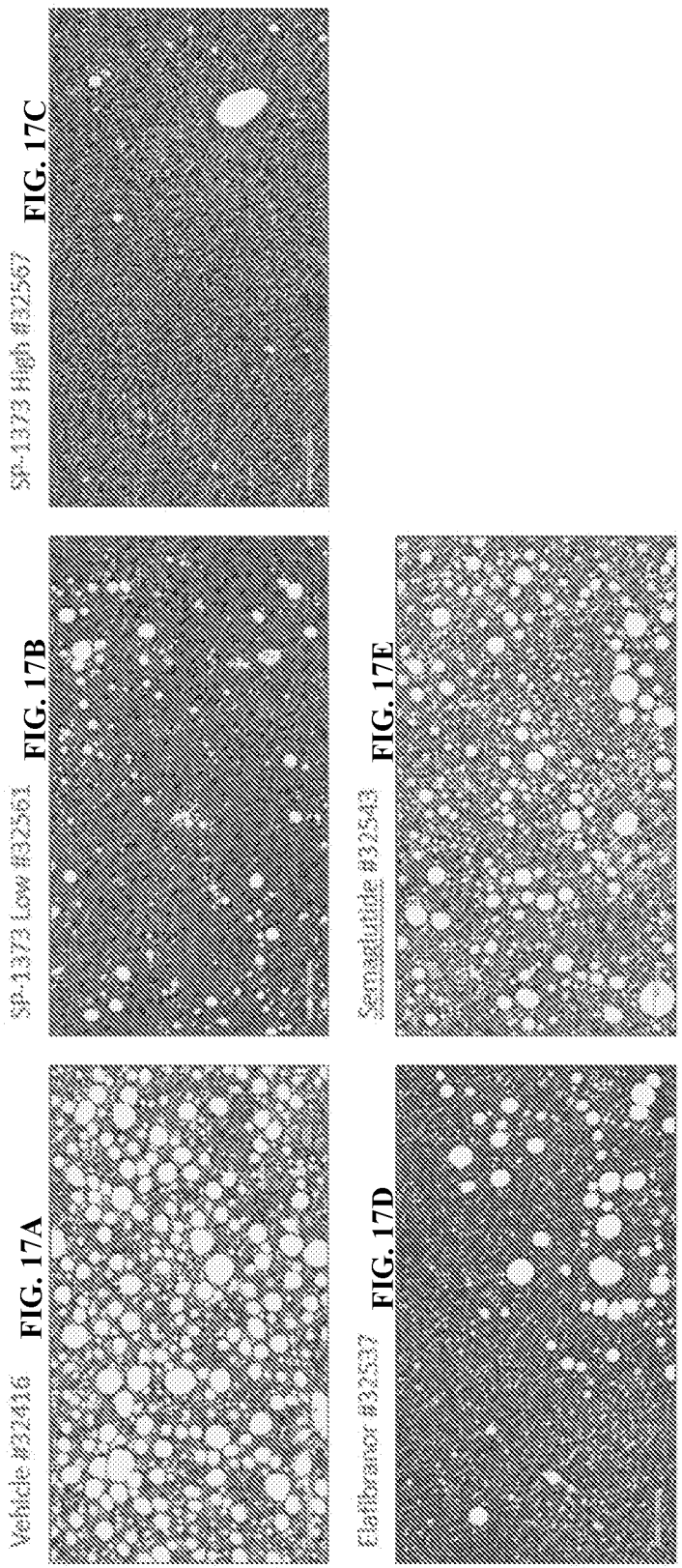

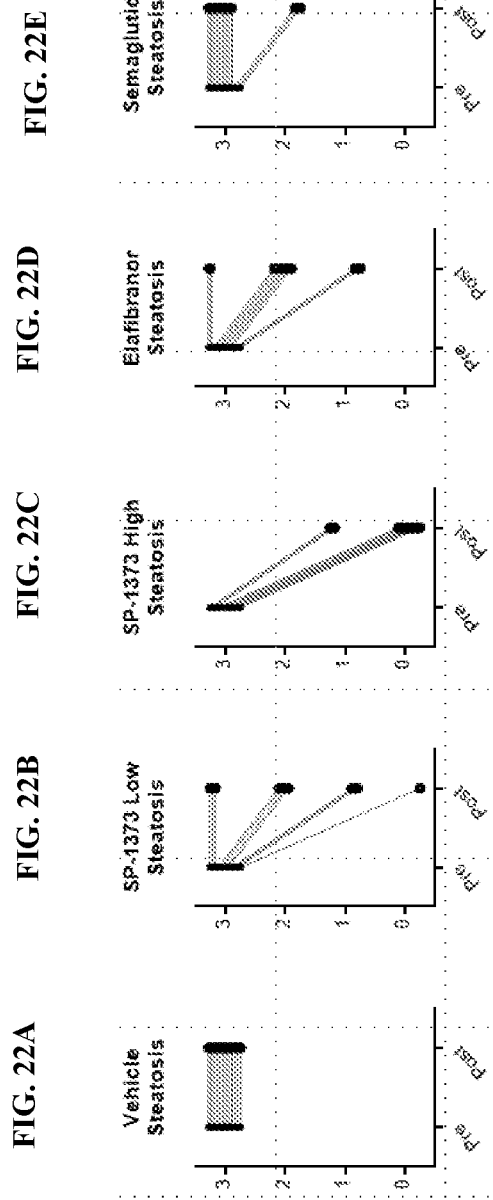

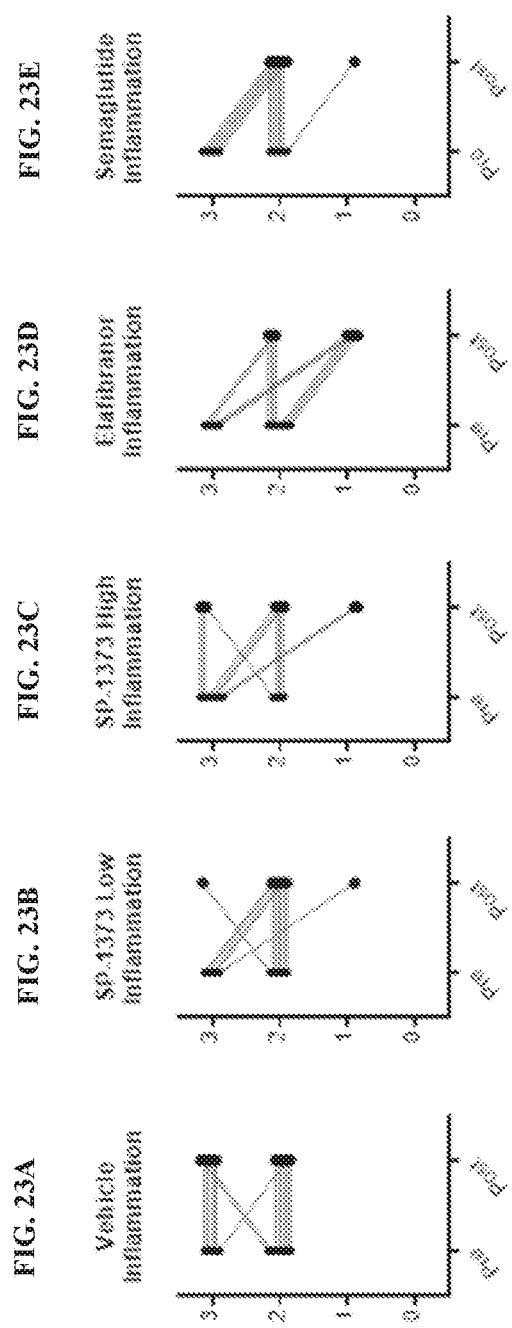

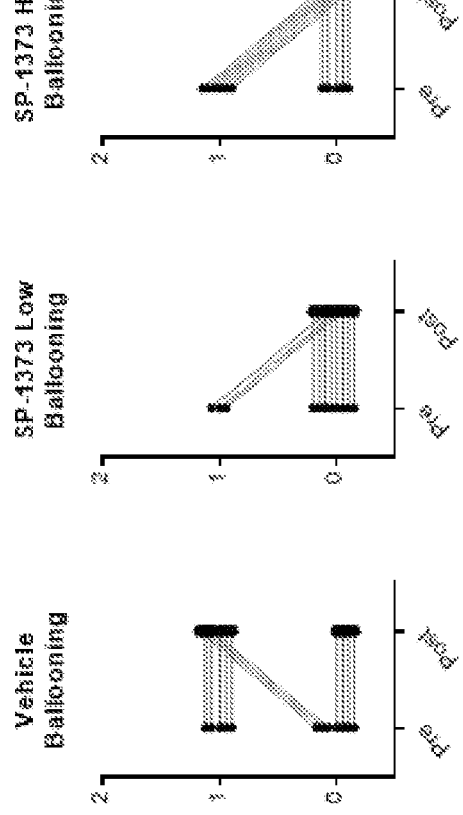

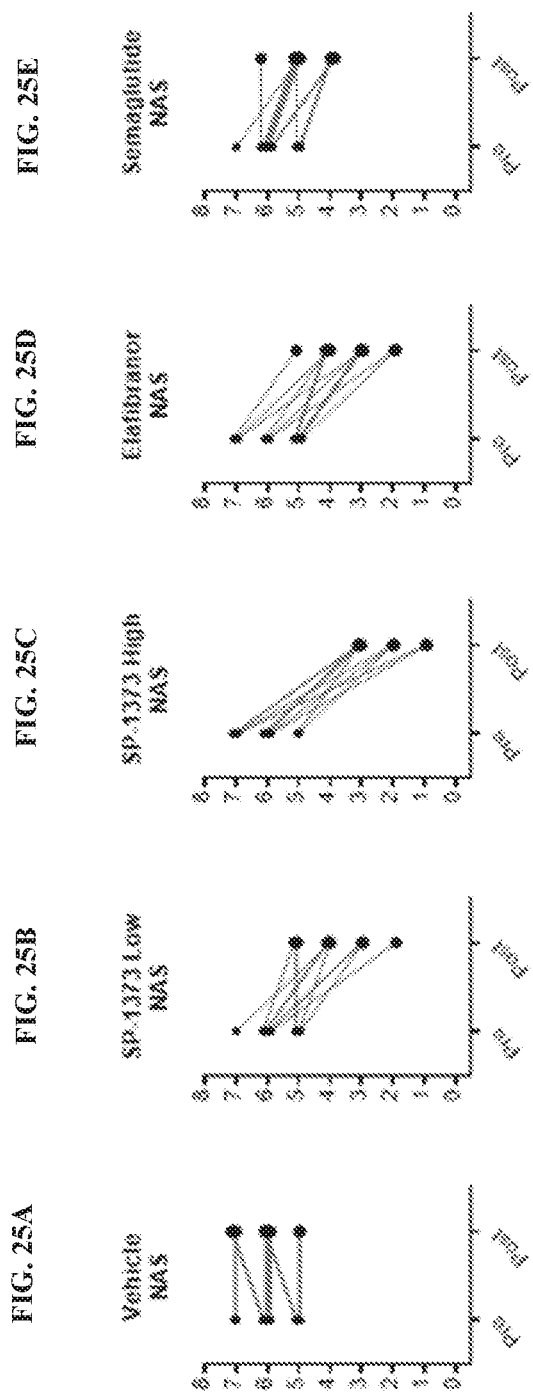

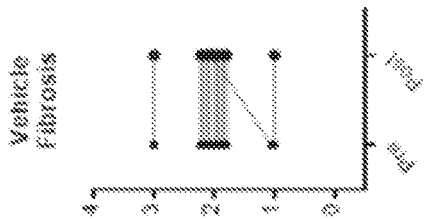
FIG. 26A Vehicle fibrosis
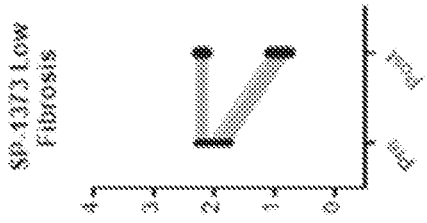
FIG. 26B SP-1373 Low fibrosis
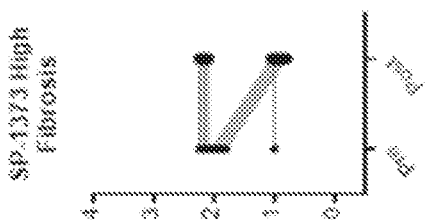
FIG. 26C SP-1373 High fibrosis
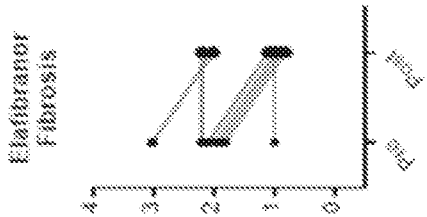
FIG. 26D Elafibranor fibrosis
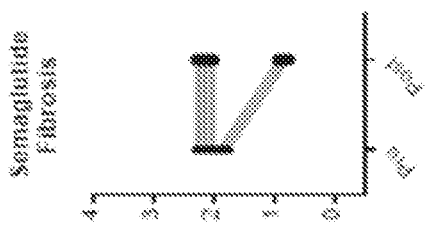
FIG. 26E Semaglutide fibrosis

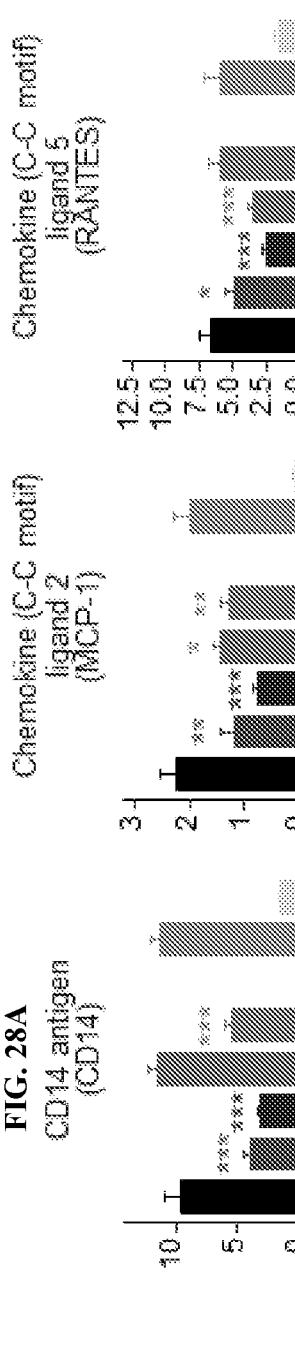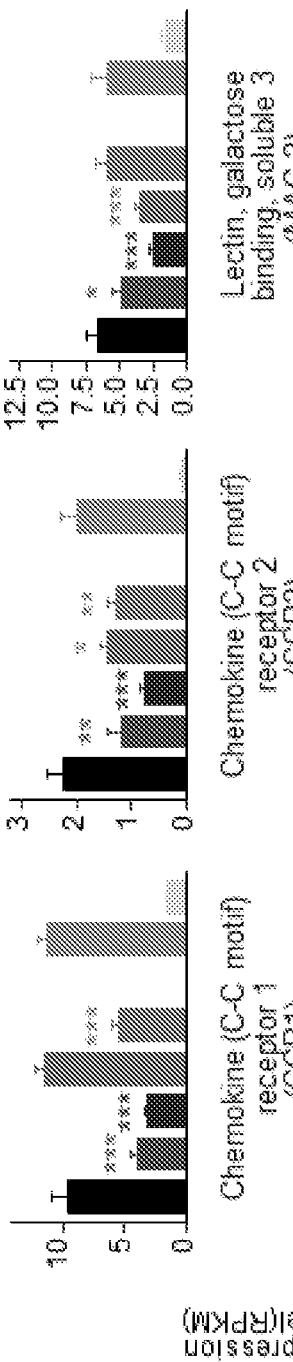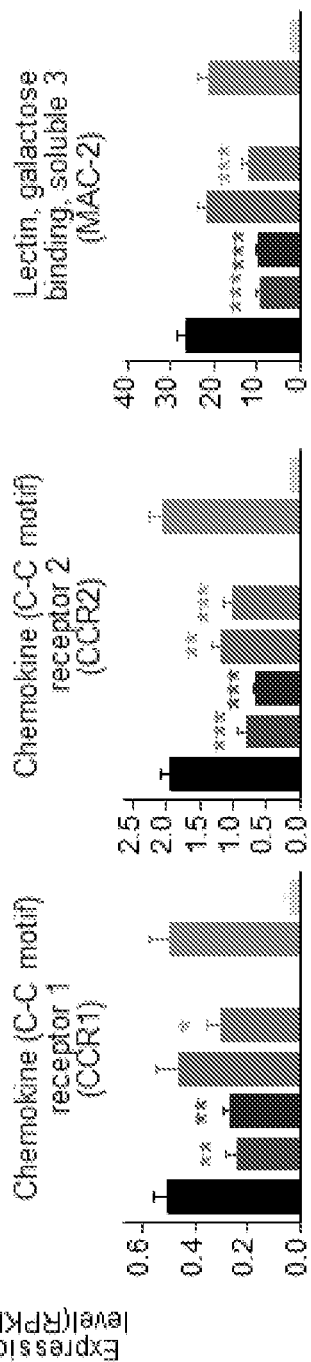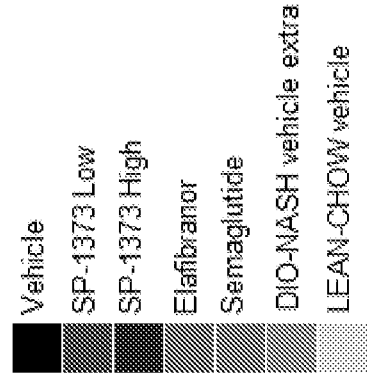

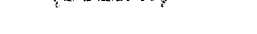
FIG. 29A     FIG. 29B     FIG. 29C
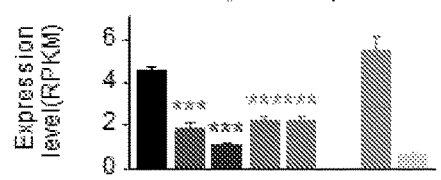
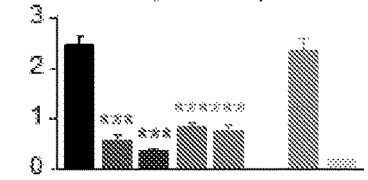
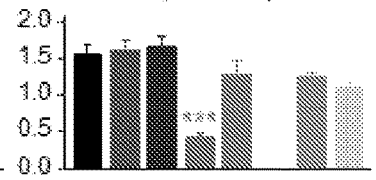
FIG. 29D     FIG. 29E     FIG. 29F
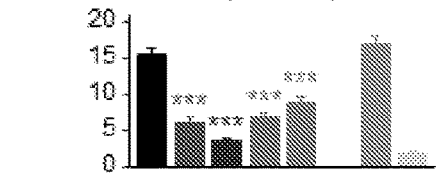
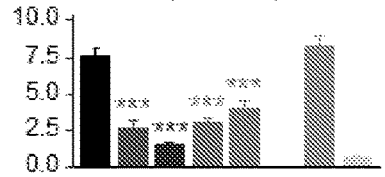
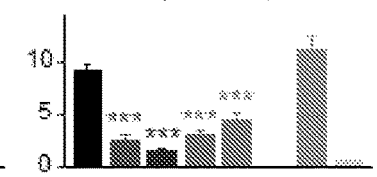
FIG. 29G     FIG. 29H     FIG. 29I

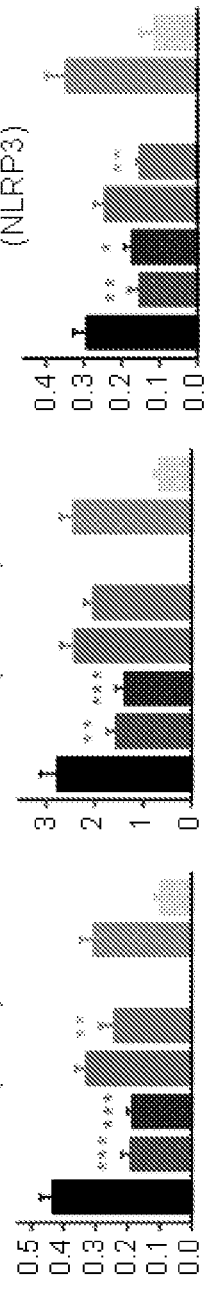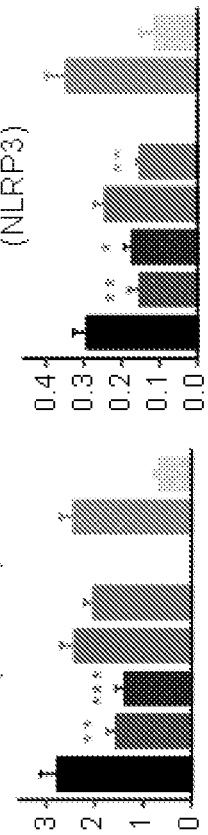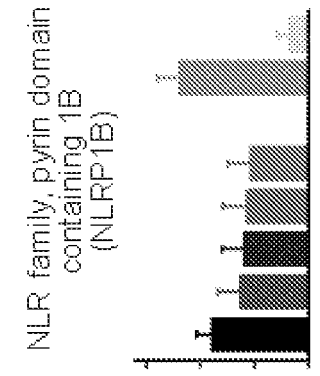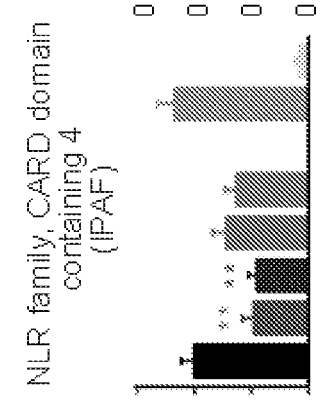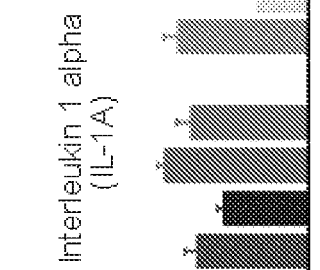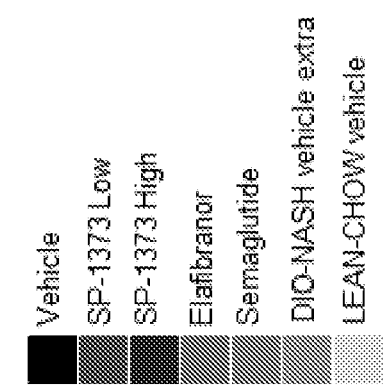

ured by NMR on days 1 (pre-dose) and 26.

PEPTIDE PHARMACEUTICALS FOR TREATMENT OF NASH AND OTHER DISORDERS

RELATED APPLICATION

This application claims the benefit of U.S. Provisional Patent Application No. 62/613,396, filed on Jan. 3, 2018, which is incorporated herein by reference in its entirety.

FIELD OF THE DISCLOSURE

The increasing prevalence of diabetes mellitus is a world health crisis of epidemic proportions that is a major contributor to patient morbidity and mortality and a major economic burden. Obesity is an important risk factor for type 2 diabetes, and roughly 90% of patients with type 2 diabetes are overweight or obese. Obesity is a rapidly increasing problem worldwide, and more than 65% of adults in the U.S. are overweight. The disclosure provides improved peptide pharmaceuticals for treatment of disorders associated with obesity or/and diabetes, such as non-alcoholic steatohepatitis (NASH) and polycystic ovary syndrome (PCOS).

SUMMARY OF THE DISCLOSURE

Described herein are peptide products and their uses in treating disorders associated with insulin resistance or/and obesity, such as type 2 diabetes, metabolic syndrome, cardiovascular diseases (including coronary artery diseases such as atherosclerosis and myocardial infarction), hypertension, NASH and PCOS, and in treating conditions associated with such disorders. The peptide products comprise a peptide covalently attached to a surfactant moiety containing a hydrophilic saccharide group and a hydrophobic group. In some embodiments, the peptide is a metabolic hormone, such as GLP-1, glucagon, oxyntomodulin or an exendin (e.g., exendin-4), or an analog or variant thereof. The peptide products have improved properties, including increased duration of action and bioavailability.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

FIG. 1 shows specific peptide products, all of which are incorporated in the disclosure.

FIG. 2 shows specificpeptide products, all of which are incorporated in the disclosure.

FIG. 3 shows specific peptide products, all of which are incorporated in the disclosure.

FIG. 4 shows specific peptide products, all of which are incorporated in the disclosure.

FIGS. 17A-17E show the effects of test compounds on liver steatosis using hematoxylin and eosin stain in DIO-NASH mice (the large eliptical structure in FIG. 17C is a vein).

FIGS. 22A-22E show the effects of test compounds on liver steatosis score in DIO-NASH mice.

FIGS. 23A-23E show the effects of test compounds on liver inflammation score in DIO-NASH mice.

FIGS. 24A-24E show the effects of test compounds on hepatocyte ballooning score in DIO-NASH mice.

FIGS. 25A-25E show the effects of test compounds on NAS (non-alcoholic fatty liver disease activity score) score in DIO-NASH mice.

FIGS. 26A-26E show the effects of test compounds on liver fibrosis score in DIO-NASH mice, where liver fibrosis was assessed by picrosirius red staining.

FIGS. 28A-28F show the effects of test compounds in DIO-NASH mice on hepatic expression of mRNAs involved in monocyte recruitment and differentiation.

FIGS. 29A-29I show the effects of test compounds in DIO-NASH mice on hepatic expression of mRNAs involved in fibrotic fiber formation.

FIGS. 31A-31F show the effects of test compounds in DIO-NASH mice on hepatic expression of mRNAs involved in pyroptosis.

DETAILED DESCRIPTION OF THE DISCLOSURE

Definitions

Figure 5:
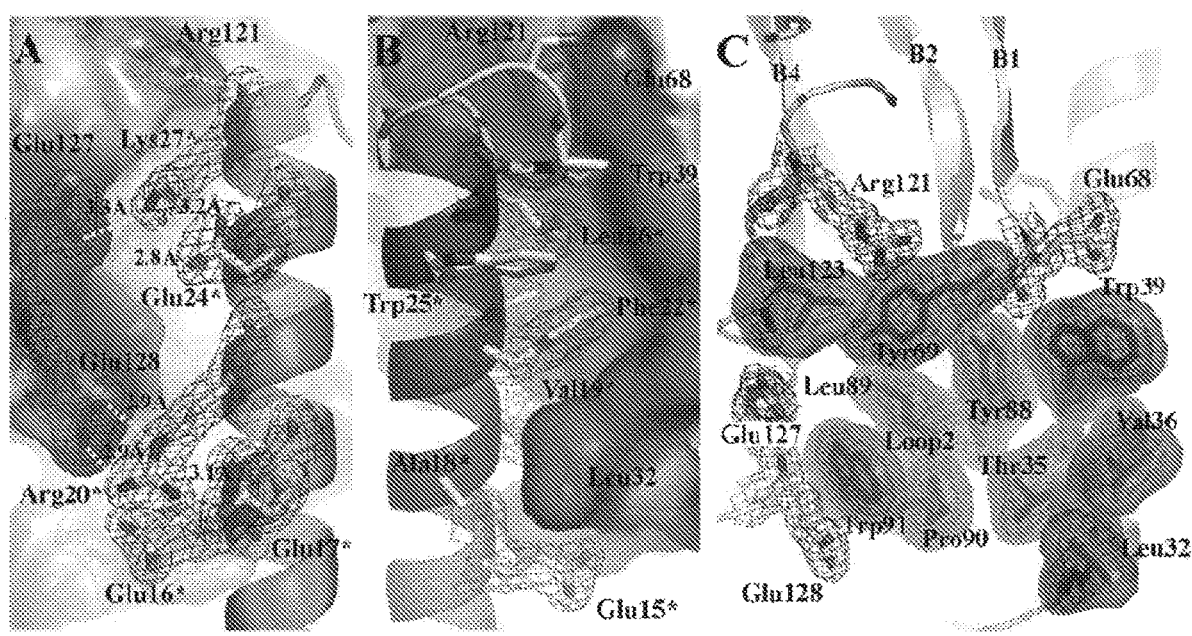
FIG. 5 illustrates the x-ray crystal structure of the binding site of the N-terminal region/extracellular domain of the GLP-1 receptor and shows a critical hydrophobic ligand-binding region ($Val^{99*}$, $Phe^{22*}$, $Trp^{25*}$ and $Leu^{26*}$ of the ligand exendin-4, and the sequence of exendin-4 beyond $Glu_{15}$ interacts as an amphiphilic helix with this region).
Figure 6:
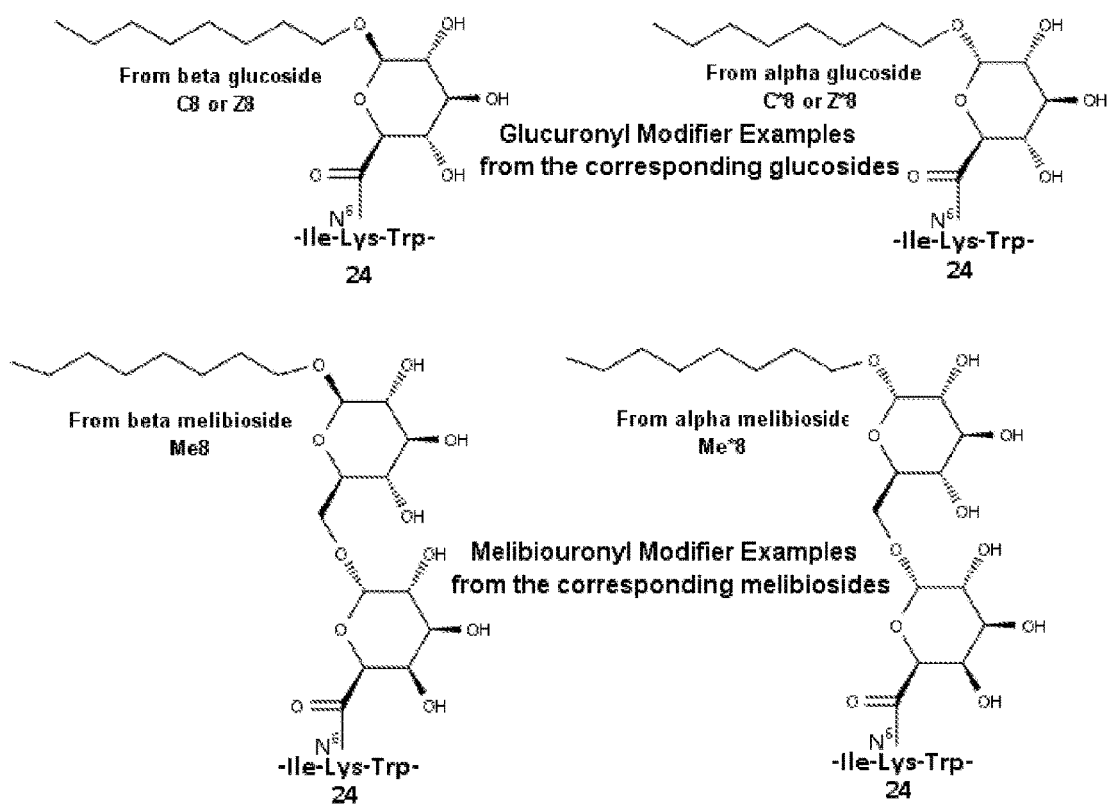
FIG. 6 illustrates the structure of three representative peptide products, EU-A992, EU-A1022 and EU-A1169, in which the epsilon (side-chain) amino group of the lysine residue at position 24 of the peptide forms an amide bond with 1-O-octyl beta-D-glucuronic acid, 1-O-octyl beta-D-melibiouronic acid or 1-O-octyl alpha-D-melibiouronic acid, respectively.
Figure 7:
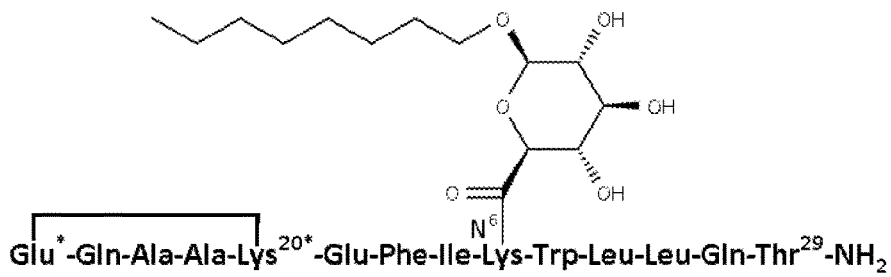
FIG. 7 is a more detailed illustration of the structure of EU-A992.

Unless defined otherwise or clearly indicated otherwise by their use herein, all technical and scientific terms used herein have the same meaning as commonly understood by those of ordinary skill in the art to which this application belongs.

As used in the specification and the appended claims, the word "a" or "an" means one or more. As used herein, the word "another" means a second or more.

The acronym "aka" means also known as.

The term "exemplary" as used herein means "serving as an example, instance or illustration". Any embodiment or feature characterized herein as "exemplary" is not necessarily to be construed as preferred or advantageous over other embodiments or features.

In some embodiments, the term "about" or "approximately" means within ±10% or 5% of the specified value. Whenever the term "about" or "approximately" precedes the first numerical value in a series of two or more numerical values or in a series of two or more ranges of numerical values, the term "about" or "approximately" applies to each one of the numerical values in that series of numerical values or in that series of ranges of numerical values.

A "peptide" comprises two or more natural or/and unnatural amino acid residues linked typically via peptide bonds. Such amino acids can include naturally occurring structural variants, naturally occurring non-proteinogenic amino acids, or/and synthetic non-naturally occurring analogs of natural amino acids. The terms "peptide" and "polypeptide" are used interchangeably herein. Peptides include short peptides (about 2-20 amino acids), medium-length peptides (about 21-50 amino acids) and long peptides (>about 50 amino acids, which can also be called "proteins"). In some embodiments, a peptide product comprises a surfactant moiety covalently attached to a peptide of no more than about 50, 40 or 30 amino acids. Synthetic peptides can be synthesized using an automated peptide synthesizer, for example. Peptides can also be produced recombinantly in cells expressing nucleic acid sequences that encode the peptides. Conventional notation is used herein to portray peptide sequences: the left-hand end of a peptide sequence is the amino (N)-terminus, and the right-hand end of a peptide sequence is the carboxyl (C)-terminus.

Standard one-letter and three-letter abbreviations for the common amino acids are used herein. Although the abbreviations used in the amino acid sequences disclosed herein represent L-amino acids unless otherwise designated as D- or DL- or the amino acid is achiral, the counterpart D-isomer generally can be used at any position (e.g., to resist proteolytic degradation). Abbreviations for other amino acids used herein include: Ac3c=1-aminocyclopropane-1-carboxylic acid; Ac4c=1-aminocyclobutane-1-carboxylic acid; Ac5c=1-aminocyclopentane-1-carboxylic acid; Ac6c=1-aminocyclohexane-1-carboxylic acid; Aib=α-aminoisobutyric acid (or 2-methylalanine or Cα-methylalanine); Bip=3-(biphenyl-4-yl)alanine; Bip2Et=3-(2'-ethylbiphenyl-4-yl)alanine; Bip2EtMeO=3-(2'-ethyl-4'-methoxybiphenyl-4-yl)alanine; Cit=citrulline; Deg=2,2-diethylglycine; Dmt=(2,6-dimethyl)tyrosine; 2FPhe=(2-fluorophenyl)alanine; 2FMePhe or 2FaMePhe=Cα-methyl-(2-fluorophenyl)alanine; hArg=homoarginine; MeLys or aMeLys=Cα-methyllysine; MePhe or aMePhe=Cα-methylphenylalanine; MePro or aMePro=Cα-methylproline; Nal1 or Nal(1)=3-(1-naphthyl)alanine; Nal2 or Nal(2)=3-(2-naphthyl)alanine; Nle=norleucine; Orn=ornithine; and Tmp=(2,4,6-trimethylphenyl)alanine. 1,2,3,4-tetrahydroisoquinoline-3-carboxylic acid (Tic) and a Tic-Phe dipeptide moiety with a reduced amide bond between the residues (designated as Tic-Ψ[CH2-NH]-Ψ-Phe) have the following structures:

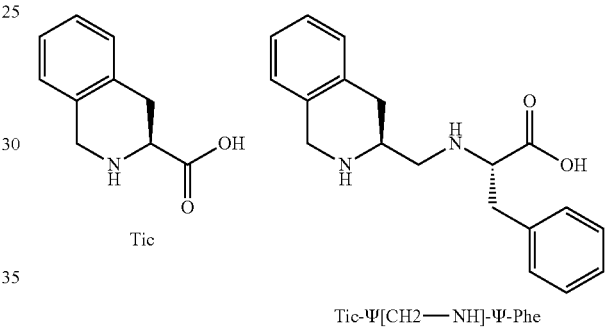

Tic

Tic-Ψ[CH2—NH]-Ψ-Phe

Unless specifically stated otherwise or the context clearly indicates otherwise, the disclosure encompasses any and all forms of a peptide that may be produced, whether the peptide is produced synthetically (e.g., using a peptide synthesizer) or by a cell (e.g., by recombinant production). Such forms of a peptide can include one or more modifications that may be made during the course of synthetic or cellular production of the peptide, such as one or more post-translational modifications, whether or not the one or more modifications are deliberate. A peptide can have the same type of modification at two or more different places, or/and can have two or more different types of modifications. Modifications that may be made during the course of synthetic or cellular production of a peptide, including chemical and post-translational modifications, include without limitation glycosylation (e.g., N-linked glycosylation and O-linked glycosylation), lipidation, phosphorylation, sulfation, acetylation (e.g., acetylation of the N-terminus), amidation (e.g., amidation of the C-terminus), hydroxylation, methylation, formation of an intramolecular or intermolecular disulfide bond, formation of a lactam between two side chains, formation of pyroglutamate, and ubiquitination. A peptide can have one or more modifications anywhere, such as the N-terminus, the C-terminus, one or more amino acid side chains, or the peptide backbone, or any combination thereof. In some embodiments, a peptide is acetylated at the N-terminus or/and has a carboxamide (—CONH$_2$) group at the C-terminus, which can increase the stability of the peptide.

Potential modifications of a peptide also include deletion of one or more amino acids, addition/insertion of one or more natural or/and unnatural amino acids, or substitution with one or more natural or/and unnatural amino acids, or any combination or all thereof. A substitution can be conservative or non-conservative. Such modifications may be deliberate, such as via site-directed mutagenesis or in the chemical synthesis of a peptide, or may be accidental, such as via mutations arising in the host cell that produces the peptide or via errors due to PCR amplification. An unnatural amino acid can have the same chemical structure as the counterpart natural amino acid but have the D stereochemistry, or it can have a different chemical structure and the D or L stereochemistry. Unnatural amino acids can be utilized, e.g., to promote α-helix formation or/and to increase the stability of the peptide (e.g., to resist proteolytic degradation).

A peptide having one or more modifications relative to a reference peptide may be called an "analog" or "variant" of the reference peptide as appropriate. An "analog" typically retains one or more essential properties (e.g., receptor binding, activation of a receptor or enzyme, inhibition of a receptor or enzyme, or other biological activity) of the reference peptide. A "variant" may or may not retain the biological activity of the reference peptide, or/and may have a different biological activity. In some embodiments, an analog or variant of a reference peptide has a different amino acid sequence than the reference peptide.

The term "conservative substitution" refers to substitution of an amino acid in a peptide with a functionally, structurally or chemically similar natural or unnatural amino acid. In certain embodiments, the following groups each contain natural amino acids that are conservative substitutions for one another:

1) Glycine (Gly/G), Alanine (Ala/A);
2) Isoleucine (Ile/I), Leucine (Leu/L), Methionine (Met/M), Valine (Val/V);
3) Phenylalanine (Phe/F), Tyrosine (Tyr/Y), Tryptophan (Trp/W);
4) Serine (Ser/S), Threonine (Thr/T), Cysteine (Cys/C);
5) Asparagine (Asn/N), Glutamine (Gln/Q);
6) Aspartic acid (Asp/D), Glutamic acid (Glu/E); and
7) Arginine (Arg/R), Lysine (Lys/K), Histidine (His/H).

In further embodiments, the following groups each contain natural amino acids that are conservative substitutions for one another:

1) non-polar: Ala, Val, Leu, Ile, Met, Pro (proline/P), Phe, Trp;
2) hydrophobic: Val, Leu, Ile, Phe, Trp;
3) aliphatic: Ala, Val, Leu, Ile;
4) aromatic: Phe, Tyr, Trp, His;
5) uncharged polar or hydrophilic: Gly, Ala, Pro, Ser, Thr, Cys, Asn, Gln, Tyr;
6) aliphatic hydroxyl- or sulfhydryl-containing: Ser, Thr, Cys;
7) amide-containing: Asn, Gln;
8) acidic: Asp, Glu;
9) basic: Lys, Arg, His; and
10) small: Gly, Ala, Ser, Cys.

In other embodiments, amino acids may be grouped as set out below:

1) hydrophobic: Val, Leu, Ile, Met, Phe, Trp;
2) aromatic: Phe, Tyr, Trp, His;
3) neutral hydrophilic: Gly, Ala, Pro, Ser, Thr, Cys, Asn, Gln;
4) acidic: Asp, Glu;
5) basic: Lys, Arg, His; and
6) residues that influence backbone orientation: Pro.

Examples of unnatural or non-proteinogenic amino acids include without limitation alanine analogs (e.g., α-ethylGly [α-aminobutyric acid or Abu], α-n-propylGly [norvaline or Nva], α-tert-butylGly [Tbg], α-vinylGly [Vg or Vlg], α-allylGly [Alg], α-propargylGly [Prg], 3-cyclopropylAla [Cpa] and Aib), leucine analogs (e.g., Nle), proline analogs (e.g., α-MePro), phenylalanine analogs {e.g., Phe(2-F), Phe(2-Me), Tmp, Bip, Bip(2'-Et-4'-OMe), Nal1, Na2, Tic, α-MePhe, α-MePhe(2-F) and α-MePhe(2-Me)}, tyrosine analogs (e.g., Dmt and α-MeTyr), serine analogs (e.g., homoserine [isothreonine or hSer]), glutamine analogs (e.g., Cit), arginine analogs (e.g., hArg), lysine analogs (e.g, homolysine [hLys], Orn and α-MeLys), α,α-disubstituted amino acids (e.g., Aib, α,α-diethylGly [Deg], α-cyclohexylAla [2-Cha], Ac3c, Ac4c, Ac5c and Ac6c), and other unnatural amino acids disclosed in A. Santoprete et al., *J. Pept. Sci.*, 17:270-280 (2011). α,α-Disubstituted amino acids can provide conformational restraint or/and α-helix stabilization. A reduced amide bond between two residues (as in, e.g., Tic-Ψ[CH2-NH]-Ψ-Phe) increases protease resistance and may also, e.g., alter receptor binding.

The disclosure encompasses all pharmaceutically acceptable salts of peptides, including those with a positive net charge, those with a negative net charge, and those with no net charge.

Saccharides include monosaccharides, disaccharides and oligosaccharides (e.g., trisaccharides, tetrasaccharides and so on). A reducing saccharide exists in a ring form and an open-chain form in equilibrium, which generally favors the ring form. A functionalized saccharide of a surfactant moiety has a functional group suitable for forming a covalent bond with an amino acid of a peptide.

An "alkyl" group refers to an aliphatic hydrocarbon group. An alkyl group can be saturated or unsaturated, and can be straight-chain (linear), branched or cyclic. In some embodiments, an alkyl group is not cyclic. In some embodiments, an alkyl group contains 1-30, 6-30, 6-20 or 8-20 carbon atoms. A "substituted" alkyl group is substituted with one or more substituents. In some embodiments, the one or more substituents are independently selected from halogens, nitro, cyano, oxo, hydroxy, alkoxy, haloalkoxy, aryloxy, thiol, alkylthio, arylthio, alkylsulfoxide, arylsulfoxide, alkylsulfone, arylsulfone, amino, alkylamino, dialkylamino, arylamino, alkoyl, carboxyl, carboxylate, esters, amides, carbonates, carbamates, ureas, alkyl, haloalkyl, fluoroalkyl, aralkyl, alkyl chains containing an acyl group, heteroalkyl, heteroalicyclic, aryl, alkoxyaryl, heteroaryl, hydrophobic natural compounds (e.g., steroids), and the like.

In some embodiments, an alkyl group as a substituent is linear or branched $C_1$-$C_6$ alkyl, which can be called "lower alkyl". Non-limiting examples of lower alkyl groups include methyl, ethyl, propyl (including n-propyl and isopropyl), butyl (including all isomeric forms, such as n-butyl, isobutyl, sec-butyl and tert-butyl), pentyl (including all isomeric forms, such as n-pentyl), and hexyl (including all isomeric forms, such as n-hexyl).

In some embodiments, an alkyl group is attached to the Nα-atom of a residue (e.g., Tyr or Dmt) of a peptide. In certain embodiments, an N-alkyl group is straight or branched $C_1$-$C_{10}$ alkyl, or aryl-substituted alkyl such as benzyl, phenylethyl or the like. One or two alkyl groups can be attached to the Nα-atom of the N-terminal residue.

In some embodiments, an alkyl group is a 1-alkyl group that is attached to the C-1 position of a saccharide (e.g., glucose) via a glycosidic bond (e.g., an O-, S-, N- or C-glycosidic bond). In some embodiments, such a 1-alkyl group is an unsubstituted or substituted $C_1$-$C_{30}$, $C_6$-$C_{30}$, $C_6$-$C_{20}$ or $C_8$-$C_{20}$ alkyl group.

In some embodiments, an alkyl group (e.g., a 1-alkyl group) is substituted with one or more (e.g., 2 or 3) groups independently selected from aryl, —OH, —OR$^1$, —SH, —SR$^1$, —NH$_2$, —NHR$^1$, —N(R')$_2$, oxo (=O), —C(=O)R$^2$, carboxyl (—CO$_2$H), carboxylate (—CO$_2$), —C(=O)OR$^1$, —OC(=O)R$^3$, —C(=O)N(R$^1$)$_2$, —NR$^4$C(=O)R$^3$, —OC(=O)OR$^5$, —OC(=O)N(R')$_2$, —NR$^4$C(=O)OR$^5$, and —NR$^4$C(=O)N(R)$_2$, wherein:

R$^1$ at each occurrence independently is hydrogen, alkyl or aryl, or both occurrences of R$^1$ and the nitrogen atom to which they are connected form a heterocyclyl or heteroaryl ring;

R$^2$ at each occurrence independently is alkyl, heterocyclyl, aryl or heteroaryl;

R$^3$ at each occurrence independently is hydrogen, alkyl, heterocyclyl, aryl or heteroaryl;

R$^4$ at each occurrence independently is hydrogen or alkyl; and

R$^5$ at each occurrence independently is alkyl or aryl.

In some embodiments, an alkyl group (e.g., a 1-alkyl group) is internally or/and terminally substituted with a carboxyl/carboxylate group, an aryl group or an —O-aryl group. In certain embodiments, an alkyl group (e.g., a 1-alkyl group) is substituted with a carboxyl or carboxylate group at the distal end of the alkyl group. In further embodiments, an alkyl group (e.g., a 1-alkyl group) is substituted with an aryl group at the distal end of the alkyl group. In other embodiments, an alkyl group (e.g., a 1-alkyl group) is substituted with an —O-aryl group at the distal end of the alkyl group.

The terms "halogen", "halide" and "halo" refer to fluoride, chloride, bromide and iodide.

The term "acyl" refers to —C(=O)R, where R is an aliphatic group that can be saturated or unsaturated, and can be linear, branched or cyclic. In certain embodiments, R contains 1-20, 1-10 or 1-6 carbon atoms. An acyl group can optionally be substituted with one or more groups, such as halogens, oxo, hydroxyl, alkoxy, thiol, alkylthio, amino, alkylamino, dialkylamino, cycloalkyl, aryl, acyl, carboxyl, esters, amides, hydrophobic natural compounds (e.g., steroids), and the like.

The terms "heterocyclyl" and "heterocyclic" refer to a monocyclic non-aromatic group or a multicyclic group that contains at least one non-aromatic ring, wherein at least one non-aromatic ring contains one or more heteroatoms independently selected from O, N and S. The non-aromatic ring containing one or more heteroatoms may be attached or fused to one or more saturated, partially unsaturated or aromatic rings. In certain embodiments, a heterocyclyl or heterocyclic group has from 3 to 15, or 3 to 12, or 3 to 10, or 3 to 8, or 3 to 6 ring atoms. Heterocyclyl or heterocyclic groups include without limitation aziridinyl, azetidinyl, pyrrolidinyl, piperidinyl, morpholinyl, piperazinyl, azepanyl, azocanyl, oxiranyl, oxetanyl, tetrahydrofuranyl (oxolanyl), tetrahydropyranyl, oxepanyl and oxocanyl.

The term "aryl" refers to a monocyclic aromatic hydrocarbon group or a multicyclic group that contains at least one aromatic hydrocarbon ring. In certain embodiments, an aryl group has from 6 to 15, or 6 to 12, or 6 to 10 ring atoms. Aryl groups include without limitation phenyl, naphthalenyl (naphthyl), fluorenyl, azulenyl, anthryl, phenanthryl, biphenyl and terphenyl. The aromatic hydrocarbon ring of an aryl group may be attached or fused to one or more saturated, partially unsaturated or aromatic rings—e.g., dihydronaphthyl, indenyl, indanyl and tetrahydronaphthyl (tetralinyl). An aryl group can optionally be substituted with one or more (e.g., 2 or 3) substituents independently selected from halogens (including —F and —Cl), cyano, nitro, hydroxyl, alkoxy, thiol, alkylthio, alkylsulfoxide, alkylsulfone, amino, alkylamino, dialkylamino, alkyl, haloalkyl (including fluoroalkyl such as trifluoromethyl), acyl, carboxyl, esters, amides, and the like.

The term "heteroaryl" refers to a monocyclic aromatic group or a multicyclic group that contains at least one aromatic ring, wherein at least one aromatic ring contains one or more heteroatoms independently selected from O, N and S. The heteroaromatic ring may be attached or fused to one or more saturated, partially unsaturated or aromatic rings that may contain only carbon atoms or that may contain one or more heteroatoms. In certain embodiments, a heteroaryl group has from 5 to 15, or 5 to 12, or 5 to 10 ring atoms. Monocyclic heteroaryl groups include without limitation pyrrolyl, pyrazolyl, pyrazolinyl, imidazolyl, oxazolyl, isoxazolyl, thiazolyl, thiadiazolyl, isothiazolyl, furanyl, thienyl (thiophenyl), oxadiazolyl, triazolyl, tetrazolyl, pyridyl, pyridonyl, pyrazinyl, pyrimidinyl, pyridazinyl, pyridazinonyl and triazinyl. Non-limiting examples of bicyclic heteroaryl groups include indolyl, benzothiazolyl, benzothiadiazolyl, benzoxazolyl, benzisoxazolyl, benzothienyl (benzothiophenyl), quinolinyl, tetrahydroisoquinolinyl, isoquinolinyl, benzimidazolyl, benzotriazolyl, indolizinyl, benzofuranyl, isobenzofuranyl, chromonyl, coumarinyl, cinnolinyl, quinazolinyl, quinoxalinyl, indazolyl, naphthyridinyl, phthalazinyl, quinazolinyl, purinyl, pyrrolopyridinyl, furopyridinyl, thienopyridinyl, dihydroisoindolyl and tetrahydroquinolinyl.

The term "steroid nucleus" refers to the core of steroids comprising an arrangement of four fused rings designated A, B, C and D as shown below:

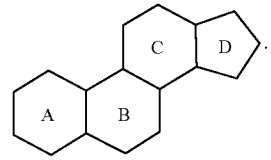

A steroid nucleus can bear one or more groups, such as halogens, hydroxyl, oxo, alkyl, acyl, carboxyl, esters, amides, and the like. Steroid nucleus-containing moieties include, but are not limited to, cholesterol and the like.

The term "pharmaceutically acceptable" refers to a substance (e.g., an active ingredient or an excipient) that is suitable for use in contact with the tissues and organs of a subject without excessive irritation, allergic response, immunogenicity and toxicity, is commensurate with a reasonable benefit/risk ratio, and is effective for its intended use. A "pharmaceutically acceptable" excipient or carrier of a pharmaceutical composition is also compatible with the other ingredients of the composition.

The term "therapeutically effective amount" refers to an amount of a compound that, when administered to a subject, is sufficient to prevent, reduce the risk of developing, delay the onset of, slow the progression of or cause regression of the medical condition being treated, or to alleviate to some extent the medical condition or one or more symptoms or complications of that condition, at least in some fraction of the subjects taking that compound. The term "therapeutically effective amount" also refers to an amount of a compound that is sufficient to elicit the biological or medical response of a cell, tissue, organ or human which is sought by a medical doctor or clinician.

The terms "treat," "treating" and "treatment" include alleviating, ameliorating, inhibiting the progress of, reversing or abrogating a medical condition or one or more symptoms or complications associated with the condition, and alleviating, ameliorating or eradicating one or more causes of the condition. Reference to "treatment" of a medical condition includes prevention of the condition. The terms "prevent", "preventing" and "prevention" include precluding, reducing the risk of developing and delaying the onset of a medical condition or one or more symptoms or complications associated with the condition.

The term "medical conditions" (or "conditions" for brevity) includes diseases and disorders. The terms "diseases" and "disorders" are used interchangeably herein.

Obesity and Insulin Resistance

Obesity leads to insulin resistance, which is a decreased ability of the cells in the body to respond to insulin stimulation through a decreased number of insulin receptors and a decreased coupling of insulin receptors to critical intracellular signaling systems. The obese state also leads to metabolic syndrome, which is a constellation of disorders including insulin resistance, hypertension, atherosclerosis, etc. Insulin resistance often results in type 2 diabetes. Prolonged hyperglycemia increases the risk of micro- and macrovascular complications, sensory neuropathy, myocardial infarction, stroke, macrovascular mortality, and all-cause mortality. Type 2 diabetes, metabolic syndrome, and other obesity- and insulin resistance-associated diseases are huge financial and healthcare burdens worldwide.

Metabolic Hormones

Incretins are metabolic hormones that induce a decrease in blood glucose levels. Incretins are released after eating and stimulate insulin production and secretion from pancreatic beta cells of the islets of Langerhans by a blood glucose-dependent mechanism. Incretins also slow the rate of absorption of nutrients into the bloodstream by slowing gastric emptying, which induces satiety and thus suppresses appetite. Furthermore, incretins inhibit glucagon release from the alpha cells of the islets of Langerhans. The two main incretins are glucagon-like peptide-1 (GLP-1) and gastric inhibitory peptide (GIP, also known as glucose-dependent insulinotropic polypeptide), which are secreted by intestinal L-cells and are members of the glucagon peptide superfamily. GLP-1 and GIP are rapidly degraded by dipeptidyl peptidase 4 (DPP-4). People with type 2 diabetes have impaired insulin secretion from pancreatic beta cells in response to GLP-1.

GLP-1 has other beneficial effects. For example, GLP-1 stimulates pancreatic beta-cell proliferation, increases peripheral insulin sensitivity and liver glucose uptake and glycogen production, and improves cardiac function (e.g., left ventricular function).

Like GLP-1, oxyntomodulin (OXM) is derived from preproglucagon and is secreted from L-cells in the gut in response to eating. OXM is essentially glucagon with a C-terminal extension of 8 amino acid residues. OXM activates both the glucagon receptor (GCGR) and the GLP-1 receptor (GLP1R), but with a 10- to 100-fold lower potency than glucagon and GLP-1. OXM induces satiety and reduces body fat (e.g., white adipose tissue). OXM causes weight loss by reducing food intake and body fat.

Glucagon is produced from preproglucagon in pancreatic alpha cells of the islets of Langerhans. Glucagon induces satiety, induces lipolysis in adipose tissues, and increases energy expenditure. Glucagon reduces body weight by reducing food intake and stimulating fat burning.

The amino acid sequences of the biologically active forms of human GLP-1, glucagon and oxyntomodulin are shown below:

GLP-1 (using glucagon numbering):
(SEQ. ID. NO. 1)
$His_1$-$Ala_2$-$Glu_3$-$Gly_4$-$Thr_5$-$Phe_6$-$Thr_7$-$Ser_8$-$Asp_9$-

$Val_{10}$-$Ser_{11}$-$Ser_{12}$-$Tyr_{13}$-$Leu_{14}$-$Glu_{15}$-$Gly_{16}$-$Gln_{17}$-

$Ala_{18}$-$Ala_{19}$-$Lys_{20}$-$Glu_{21}$-$Phe_{22}$-$Ile_{23}$-$Ala_{24}$-$Trp_{25}$-

$Leu_{26}$-$Val_{27}$-$Lys_{28}$-$Gly_{29}$-$Arg_{30}$

Glucagon:
(SEQ. ID. NO. 2)
$His_1$-$Ser_2$-$Gln_3$-$Gly_4$-$Thr_5$-$Phe_6$-$Thr_7$-$Ser_8$-$Asp_9$-

$Tyr_{10}$-$Ser_{11}$-$Lys_{12}$-$Tyr_{13}$-$Leu_{14}$-$Asp_{15}$-$Ser_{16}$-$Arg_{17}$-

$Arg_{18}$-$Ala_{19}$-$Gln_{20}$-$Asp_{21}$-$Phe_{22}$-$Val_{23}$-$Gln_{24}$-$Trp_{25}$-

$Leu_{26}$-$Met_{27}$-$Asn_{28}$-$Thr_{29}$

Oxyntomodulin:
(SEQ. ID. NO. 3)
$His_1$-$Ser_2$-$Gln_3$-$Gly_4$-$Thr_5$-$Phe_6$-$Thr_7$-$Ser_8$-$Asp_9$-

$Tyr_{10}$-$Ser_{11}$-$Lys_{12}$-$Tyr_{13}$-$Leu_{14}$-$Asp_{15}$-$Ser_{16}$-$Arg_{17}$-

$Arg_{18}$-$Ala_{19}$-$Gln_{20}$-$Asp_{21}$-$Phe_{22}$-$Val_{23}$-$Gln_{24}$-$Trp_{25}$-

$Leu_{26}$-$Met_{27}$-$Asn_{28}$-$Thr_{29}$-$Lys_{30}$-$Arg_{31}$-$Asn_{32}$-$Arg_{33}$-

$Asn_{34}$-$Asn_{35}$-$Ile_{36}$-$Ala_{37}$

Amino acid residues throughout the sequences of GLP-1 and glucagon can be replaced while retaining biological activity. For example, replacement by Ala is well accepted in the N-terminal region of GLP-1, especially at positions 2, 3, 5, 8, 11 and 12 (Adelhorst et al., *J. Biol. Chem.*, 269: 6275-6278 [1994]). Furthermore, short N-terminal analogs of GLP-1 can potently bind and activate GLP1R (Mapelli et al., *J. Med. Chem.*, 52:7788-7799 [2009]; and Haque et al., *Peptides,* 31:950-955 and 1353-1360 [2010]). Chimeric analogs able to bind to both GLP1R and GCGR can be created by grafting C-terminal residues from GLP-1 onto N-terminal residues of glucagon (Hjorth et al., *J. Biol. Chem.,* 269:30121-30124 [1994]).

The disclosure provides peptide products comprising a peptide gut hormone (e.g., GLP-1, GIP, glucagon, oxyntomodulin or an exendin [e.g., exendin-4]), or an analog or variant thereof, that is covalently attached to a surfactant moiety. The peptide products are potent agonists of the receptor(s) of the underlying peptide, promote metabolic homeostasis, and have a long duration of action and enhanced bioavailability. In some embodiments, the peptide products are agonists of the GLP-1 receptor (GLP1R). GLP1R agonists stimulate blood glucose-dependent insulin secretion and increase insulin sensitivity with a reduced risk of hypoglycemia, and induce satiety that reduces food intake and hence reduces weight gain or causes weight loss. In further embodiments, the peptide products are dual agonists of GLP1R and the glucagon receptor (GCGR), which adds the benefits of GCGR activation, including stimulation of fat burning, loss of body fat mass and prevention of hypoglycemia.

Peptide Products

Peptide and proteins often have deficiencies in their use as medicines, including instability in the formulation, aggregation, short duration of action and poor bioavailability. Disclosed herein are peptide products that have improved properties as pharmaceuticals, including increased stability, half-life, duration of action and bioavailability, and reduced immunogenicity. The peptide products comprise a peptide covalently attached to a surfactant moiety containing a hydrophilic saccharide group and a hydrophobic group. In some embodiments, the peptide is attached to the saccharide group, which is in turn attached to the hydrophobic group. In some embodiments, the peptide is a metabolic hormone, such as GLP-1, glucagon, oxyntomodulin or an exendin (e.g., exendin-4), or an analog or variant thereof. The peptide products are useful for treating, e.g., insulin resistance, diabetes, obesity, metabolic syndrome and cardiovascular diseases, and conditions linked thereto, such as NASH and PCOS.

In some embodiments, a peptide product comprises GLP-1 or an analog or variant thereof covalently attached to a surfactant moiety (e.g., an alkyl glycoside such as a 1-alkyl glycoside). The GLP-1 peptide can have a native or non-native amino acid sequence or structure. The alkyl group can be unsubstituted or substituted (e.g., with a carboxyl/carboxylate, aryl or oxyaryl group). In certain embodiments, the alkyl glycoside is a 1-O-alkyl β-D-glucuronic acid.

In further embodiments, a peptide product comprises glucagon or an analog or variant thereof covalently attached to a surfactant moiety (e.g., an alkyl glycoside such as a 1-alkyl glycoside). The glucagon peptide can have a native or non-native amino acid sequence or structure. The alkyl group can be unsubstituted or substituted (e.g., with a carboxyl/carboxylate, aryl or oxyaryl group). In certain embodiments, the alkyl glycoside is a 1-O-alkyl β-D-glucuronic acid.

In additional embodiments, a peptide product comprises oxyntomodulin or an analog or variant thereof covalently attached to a surfactant moiety (e.g., an alkyl glycoside such as a 1-alkyl glycoside). The oxyntomodulin peptide can have a native or non-native amino acid sequence or structure. The alkyl group can be unsubstituted or substituted (e.g., with a carboxyl/carboxylate, aryl or oxyaryl group). In certain embodiments, the alkyl glycoside is a 1-O-alkyl β-D-glucuronic acid.

In other embodiments, a peptide product comprises an exendin (e.g., exendin-4) or an analog or variant thereof covalently attached to a surfactant moiety (e.g., an alkyl glycoside such as a 1-alkyl glycoside). The exendin peptide can have a native or non-native amino acid sequence or structure. The alkyl group can be unsubstituted or substituted (e.g., with a carboxyl/carboxylate, aryl or oxyaryl group). In certain embodiments, the alkyl glycoside is a 1-O-alkyl β-D-glucuronic acid.

Some embodiments relate to peptide products of Formula I-A comprising a surfactant X covalently attached to a peptide, the peptide comprising a linker amino acid U and at least one other amino acid:

Formula I-A

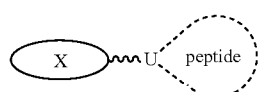

wherein the surfactant X is a moiety of Formula I:

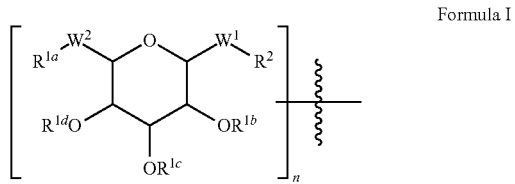

Formula I wherein:
$R^{1a}$ at each occurrence independently is a bond, H, a protecting group, a saccharide, an unsubstituted or substituted $C_1$-$C_{30}$ alkyl group, an unsubstituted or substituted aralkyl (-alkylaryl) group, an unsubstituted or substituted alkyloxyaryl group, or a steroid nucleus-containing group;
$R^{1b}$, $R^{1c}$ and $R^{1d}$ at each occurrence independently are a bond, H, a protecting group, a saccharide, an unsubstituted or substituted $C_1$-$C_{30}$ alkyl group, an unsubstituted or substituted aralkyl group, an unsubstituted or substituted alkyloxyaryl group, or a steroid nucleus-containing group;
$R^2$ at each occurrence independently is a bond, a bond to U, H, an substituted or substituted $C_1$-$C_{30}$ alkyl group, an unsubstituted or substituted aralkyl group, an unsubstituted or substituted alkyloxyaryl group, a steroid nucleus-containing group, —NH—, —S—, —O—NH—, a spacer, -triazolo-, —NH(C═O)—CH$_2$—, or —(CH$_2$)$_m$-maleimide-;
$W^1$ at each occurrence independently is —CH$_2$—, —CH$_2$—O—, —CH$_2$—S—, —CH$_2$—NH—, —(C═O)—, —(C═O)—NH—, —(C═S)—, or —(C═S)—NH—;
$W^2$ at each occurrence independently is —O—, —S—, —NH—, or —CH$_2$—;
at least one occurrence of $R^{1a}$, $R^{1b}$, $R^{1c}$, $R^{1d}$ or $R^2$ is an unsubstituted or substituted $C_1$-$C_{30}$ alkyl, aralkyl, alkyloxyaryl or steroid nucleus-containing group;
m is an integer from 1 to 10; and
n is 1, 2 or 3; and
the peptide has Formula II:

(SEQ. ID. NO. 1108)
aa$_1$-aa$_2$-aa$_3$-aa$_4$-aa$_5$-aa$_6$-aa$_7$-aa$_8$-aa$_9$-aa$_{10}$-aa$_{11}$-aa$_{12}$-aa$_{13}$- aa$_{14}$-aa$_{15}$-aa$_{16}$-aa$_{17}$-aa$_{18}$-aa$_{19}$-aa$_{20}$-aa$_{21}$-aa$_{22}$-aa$_{23}$-aa$_{24}$- aa$_{25}$-aa$_{26}$-aa$_{27}$-aa$_{28}$-aa$_{29}$-aa$_{30}$-aa$_{31}$-aa$_{32}$-aa$_{33}$-aa$_{34}$-aa$_{35}$- aa$_{36}$-aa$_{37}$-Z   Formula II wherein:
Z is —OH, —NHR$^3$ or —N(R$^4$)His, wherein:
R$^3$ is H, unsubstituted or substituted $C_1$-$C_{12}$ alkyl, or a PEG-containing group of less than 10 Da; and
R$^4$ is H, $C_2$-$C_{10}$ acyl (e.g., acetyl) or —C(═O)-aryl (e.g., benzoyl);
aa$_1$ is His, N(R$^3$)His, N(R$^4$)His, or pGlu-His;
aa$_2$ is Ser, D-Ser, Ala, Gly, Pro, MePro, Aib, Ac4c or Ac5c;
aa$_3$ is Gln or Cit;
aa$_4$ is Gly or D-Ala;
aa$_5$ is Thr or Ser;
aa$_6$ is Phe, Trp, 2FPhe, MePhe, 2FMePhe or Nal2;
aa$_7$ is Thr or Ser;

aa$_8$ is Ser or Asp;
aa$_9$ is Asp or Glu;
aa$_{10}$ is Tyr, Leu, Met, Nal2, Bip, Bip2EtMeO, Glu, Lys or U;
aa$_{11}$ is absent or Ser, Asn, Bip or U;
aa$_{12}$ is absent or Lys, Glu, Ser, Arg or U;
aa$_{13}$ is absent or Tyr, Gln, Cit or U;
aa$_{14}$ is absent or Leu, Met, Nle, Glu, Lys or U;
aa$_{15}$ is absent or Asp, Glu or U;
aa$_{16}$ is absent or Ser, Gly, Glu, Ala, Aib, Ac5c, Lys, Arg or U;
aa$_{17}$ is absent or Arg, hArg, Gln, Glu, Cit, Aib, Ac4c, Ac5c, Lys or U;
aa$_{18}$ is absent or Arg, hArg, Ala, Aib, Ac4c, Ac5c or U;
aa$_{19}$ is absent or Ala, Val, Aib, Ac4c, Ac5c or U;
aa$_{20}$ is absent or Gln, Lys, Arg, Cit, Glu, Aib, Ac4c, Ac5c or U;
aa$_{21}$ is absent or Asp, Glu, Leu, Aib, Ac4c, Ac5c or U;
aa$_{22}$ is absent or Phe, Trp, Nα12, Aib, Ac4c, Ac5c or U
aa$_{23}$ is absent or Val, Ile, Aib, Ac4c, Ac5c or U;
aa$_{24}$ is absent or Ala, Gln, Glu, Cit or U;
aa$_{25}$ is absent or Trp, Nα12 or U;
aa$_{26}$ is absent or Leu or U;
aa$_{27}$ is absent or Met, Val, Leu, Nle, Lys or U;
aa$_{28}$ is absent or Asn, Lys, Glu, Gln, Cit or U;
aa$_{29}$ is absent or Thr, Gly, Aib, Ac4c, Ac5c or U;
aa$_{30}$ is absent or Lys, Aib, Ac4c, Ac5c, Arg or U;
aa$_{31}$ is absent or Arg, Aib, Ac4c, Ac5c or U;
aa$_{32}$ is absent or Asn, Aib, Ac4c, Ac5c or U;
aa$_{33}$ is absent or Arg, Aib, Ac4c, Ac5c or U;
aa$_{34}$ is absent or Asn, Aib, Ac4c, Ac5c or U;
aa$_{35}$ is absent or Asn, Aib, Ac4c, Ac5c or U;
aa$_{36}$ is absent or Ala, Ile, Aib, Ac4c, Ac5C or U;
aa$_{37}$ is absent or U;
U is a natural or unnatural amino acid comprising a functional group used for covalent attachment to a surfactant X;
any two of aa$_1$-aa$_{37}$ can optionally be cyclized through their side chains to form a lactam; and
provided that one, or at least one, of aa$_{10}$-aa$_{37}$ is a linker amino acid U covalently attached to a surfactant X.

A surfactant moiety can also be attached to a linker amino acid U of the peptide via R$^{1a}$R$^{1b}$, R$^{1c}$ or R$^{1d}$. For example, W$^2$ can be —O— and one occurrence of R$^{1a}$ can be bond to a hydroxyl-bearing natural or unnatural amino acid (e.g., serine, homoserine or threonine), or W$^2$ can be —S— and one occurrence of R$^{1a}$ can be bond to a thiol/sulfhydryl-bearing natural or unnatural amino acid (e.g., cysteine or homocysteine), or W$^2$ can be —NH— and one occurrence of R$^{1a}$ can be bond to an amino-bearing natural or unnatural amino acid (e.g., lysine or ornithine). In certain embodiments, U attached to a surfactant moiety via R$^{1a}$ is an unnatural amino acid. A linker amino acid U attached to a surfactant moiety via R$^{1a}$ can be the L- or D-isomer. In certain embodiments, U is the D-isomer.

In some embodiments, n is 1. In other embodiments, n is 2, and a first glycoside is attached to a second glycoside via a bond between W$^2$ of the first glycoside and —OR$^{1b}$, —OR$^{1c}$ or —OR$^{1d}$ of the second glycoside. In yet other embodiments, n is 3, and a first glycoside is attached to a second glycoside via a bond between W$^2$ of the first glycoside and —OR$^{1b}$, —OR$^{1c}$ or —OR$^{1d}$ of the second glycoside, and the second glycoside is attached to a third glycoside via a bond between W$^2$ of the second glycoside and —OR$^{1b}$, —OR$^{1c}$ or OR$^{1d}$ of the third glycoside.

In some embodiments of the peptide products of Formula I-A, the surfactant X is:

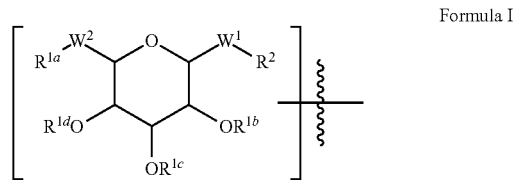

Formula I wherein:
R$^{1a}$ is H, a protecting group, a saccharide, an unsubstituted or substituted C$_1$-C$_{30}$ alkyl group, or a steroid nucleus-containing group;
R$^{1b}$, R$^{1c}$ and R$^{1d}$ independently are H, a protecting group, a saccharide, or an unsubstituted or substituted C$_1$-C$_{30}$ alkyl group;
R$^2$ is a bond to U, —NH—, —S—, -triazolo-, —NH(C=O)—CH$_2$— or —(CH$_2$)$_m$-maleimide-;
W$^1$ is —CH$_2$—, —CH$_2$—O—, —CH$_2$—S—, —(C=O)—, —(C=O)—NH—, —(C=S)—, or —(C=S)—NH—;
W$^2$ is —O— or —S—;
m is 1-10; and
at least one of R$^{1a}$, R$^{1b}$, R$^{1c}$ and R$^{1d}$ is an unsubstituted or substituted C$_1$-C$_{30}$ alkyl group or a steroid nucleus-containing group.

In certain embodiments, the surfactant X has the structure

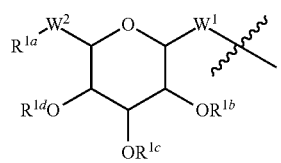

in which R$^2$ is a bond to U. In certain embodiments, W$^1$ is —C(=O)NH— and R$^2$ is a bond between W$^1$ and an amino acid residue U (e.g., the side-chain amino group of a lysine residue) of the peptide.

In other embodiments, the surfactant X is

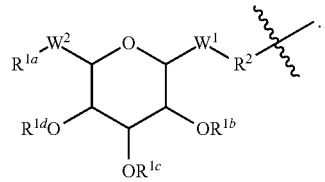

In certain embodiments, W$^1$ is —CH$_2$—O—, —CH$_2$—S— or —(C=O)—NH—, and R$^2$ is a —(CH$_2$)$_m$-maleimide-group that forms a bond with a suitable functional group of an amino acid residue U of the peptide (e.g., a thiol group of a cysteine residue forms a thioether bond with the maleimide group).

In further embodiments, the surfactant X has the structure:

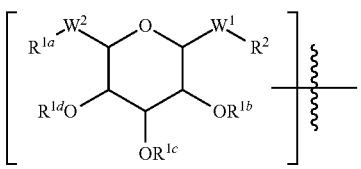

Formula I wherein:
R$^{1a}$ is H, a protecting group, a saccharide, an unsubstituted or substituted C$_1$-C$_{30}$ alkyl group, or a steroid nucleus-containing group;
R$^{1b}$, R$^{1c}$ and R$^{1d}$ independently are H, a protecting group, or an unsubstituted or substituted C$_1$-C$_{30}$ alkyl group;
R$^2$ is a bond to U;
W$^1$ is —(C=O)—NH—;
W$^2$ is —O—; and
at least one of R$^{1a}$, R$^{1b}$, R$^{1c}$ and R$^{1d}$ is an unsubstituted or substituted C$_1$-C$_{30}$ alkyl group or a steroid nucleus-containing group.

In certain embodiments, the surfactant X has the structure:

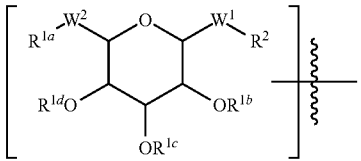

Formula I wherein:
R$^{1a}$ is an unsubstituted or substituted C$_1$-C$_{30}$ alkyl group;
R$^{1b}$, R$^{1c}$, and R$^{1d}$ are H;
R$^2$ is a bond to U;
W$^1$ is —(C=O)—NH—; and
W$^2$ is —O—.

In some embodiments, the surfactant X is a 1-O-alkyl beta-D-glucuronyl moiety:

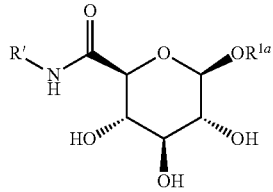

wherein R$^{1a}$ is an unsubstituted or substituted C$_1$-C$_{30}$, C$_1$-C$_{20}$ or C$_6$-C$_{20}$ alkyl group, and R' is a peptide that is attached to the surfactant moiety via the N-terminal alpha amino group or a side-chain amino group of a natural or unnatural amino acid (e.g., lysine or ornithine). In certain embodiments, R$^{1a}$ is an unsubstituted or substituted C$_8$-C$_{20}$, C$_{12}$-C$_{20}$ or C$_{12}$-C$_{16}$ alkyl group.

In some embodiments, an alkyl group attached to a saccharide is an unsubstituted or substituted C$_1$-C$_{30}$, C$_1$-C$_{20}$, C$_6$-C$_{30}$ or C$_6$-C$_{20}$ alkyl group. In certain embodiments, an alkyl group attached to a saccharide is an unsubstituted or substituted C$_8$-C$_{20}$, C$_6$-C$_{18}$ or C$_{12}$-C$_{18}$ alkyl group.

In some embodiments, at least one occurrence of R$^{1a}$, R$^{1b}$, R$^{1c}$, R$^{1d}$ or R$^2$ is an unsubstituted or substituted C$_1$-C$_{30}$ alkyl group. In certain embodiments, an alkyl group is attached to at least one occurrence of R$^{1b}$, R$^{1c}$ or R$^{1d}$ via an ether bond (—O-alkyl). In further embodiments, an alkyl group is attached to at least one occurrence of R$^2$ via an ether bond (—O-alkyl) or an amide bond [—C(=O)NH-alkyl].

In some embodiments, at least one occurrence, or the sole occurrence, of R$^{1a}$ is an unsubstituted or substituted C$_1$-C$_{30}$, C$_6$-C$_{30}$, C$_6$-C$_{20}$ or C$_8$-C$_{20}$ alkyl group. In certain embodiments, at least one occurrence, or the sole occurrence, of R$^{1a}$ is an unsubstituted or substituted C$_{12}$-C$_{20}$ alkyl group.

In some embodiments, an alkyl group (e.g., a 1-alkyl group) is internally or/and terminally substituted with a carboxyl or carboxylate group. In certain embodiments, an alkyl group (e.g., a 1-alkyl group) is substituted with a carboxyl or carboxylate group at the distal end of the alkyl group.

In additional embodiments, at least one occurrence, or the sole occurrence, of R$^{1a}$ is a saccharide. In certain embodiments, the saccharide is a galactose. The galactose can be alpha- or beta-linked. In some embodiments, the galactose is alpha-linked galactopyranose, beta-linked galactopyranose, alpha-linked galactofuranose, or beta-linked galactofuranose.

In some embodiments, the saccharide group of the surfactant moiety is a monosaccharide. In certain embodiments, the monosaccharide is a suitably functionalized glucose, galactose or mannose, such as glucuronic acid, galacturonic acid or mannouronic acid. In other embodiments, the saccharide is a disaccharide. In some embodiments, the disaccharide contains two glucose molecules, or one glucose molecule and one galactose molecule. In certain embodiments, the disaccharide is diglucuronic acid or a suitably functionalized melibiose, maltose, isomaltose, gentiobiose or lactose, such as melibiouronic acid, maltouronic acid, isomaltouronic acid, gentiobiouronic acid or lactouronic acid. The terms "-uronic acid" and "-uronyl" are used interchangeably herein in regard to a saccharide group of a surfactant moiety.

In some embodiments, the surfactant X is a 1-alkyl glycoside, wherein an unsubstituted or substituted alkyl group is attached to the C-1 position of a saccharide via a glycosidic bond. The glycosidic bond can be an O-, S-, N- or C-glycosidic bond. In certain embodiments, the glycosidic bond is an O-glycosidic bond. The 1-alkyl group can be the beta- or alpha-anomer. In certain embodiments, 1-alkyl group is the beta-anomer.

In some embodiments, the surfactant X is selected from 1-eicosyl beta-D-glucuronic acid, 1-octadecyl beta-D-glucuronic acid, 1-hexadecyl beta-D-glucuronic acid, 1-tetradecyl beta-D-glucuronic acid, 1-dodecyl beta-D-glucuronic acid, 1-decyl beta-D-glucuronic acid, 1-octyl beta-D-glucuronic acid, 1-eicosyl beta-D-diglucuronic acid, 1-octadecyl beta-D-diglucuronic acid, 1-hexadecyl beta-D-diglucuronic acid, 1-tetradecyl beta-D-diglucuronic acid, 1-dodecyl beta-D-diglucuronic acid, 1-decyl beta-D-diglucuronic acid, 1-octyl beta-D-diglucuronic acid, 1-eicosyl beta-D-isomaltouronic acid, 1-octadecyl beta-D-isomaltouronic acid, 1-hexadecyl beta-D-isomaltouronic acid, 1-tetradecyl beta-D-isomaltouronic acid, 1-dodecyl beta-D-isomaltouronic acid, 1-decyl beta-D-isomaltouronic acid, 1-octyl beta-D-isomaltouronic acid, 1-eicosyl beta-D-gentiobiouronic acid, 1-octadecyl beta-D-gentiobiouronic acid, 1-hexadecyl beta-D-gentiobiouronic acid, 1-tetradecyl beta-D-gentiobiouronic acid, 1-dodecyl beta-D-gentiobiouronic acid, 1-decyl beta-D-gentiobiouronic acid, 1-octyl beta-D- gentiobiouronic acid, 1-eicosyl beta-D-melibiouronic acid, 1-octadecyl beta-D-melibiouronic acid, 1-hexadecyl beta-D-melibiouronic acid, 1-tetradecyl beta-D-melibiouronic acid, 1-dodecyl beta-D-melibiouronic acid, 1-decyl beta-D-melibiouronic acid, 1-octyl beta-D-melibiouronic acid, functionalized 1-eicosyl beta-D-glucose, 1-octadecyl beta-D-glucose, 1-hexadecyl beta-D-glucose, 1-tetradecyl beta-D-glucose, 1-dodecyl beta-D-glucose, 1-decyl beta-D-glucose, 1-octyl beta-D-glucose, 1-eicosyl beta-D-maltoside, 1-octadecyl beta-D-maltoside, 1-hexadecyl beta-D-maltoside, 1-tetradecyl beta-D-maltoside, 1-dodecyl beta-D-maltoside, 1-decyl beta-D-maltoside, 1-octyl beta-D-maltoside, 1-eicosyl beta-D-melibioside, 1-octadecyl beta-D-melibioside, 1-hexadecyl beta-D-melibioside, 1-tetradecyl beta-D-melibioside, 1-dodecyl beta-D-melibioside, 1-decyl beta-D-melibioside, 1-octyl beta-D-melibioside, the corresponding 1-alkyl glycosides with a 6-carboxyl group or 6,6'-dicarboxyl groups, the corresponding 1-alkyl alpha-anomers, and the like. In certain embodiments, the surfactant X is a 1-alkyl beta-D-glucuronic acid.

As illustrative examples, shown below are a 1-O-octyl beta-D-melibiouronyl moiety (upper left), a 1-O-hexadecyl beta-D-gentiobiouronyl moiety (upper right), a 1-O-dodecyl beta-D-maltouronyl moiety (lower left, either or both carboxyl groups can be attached to the peptide), and a 1-O-tetradecyl beta-D-isomaltouronyl moiety (lower right) attached to an amino group of a peptide (e.g., the side-chain amino group of a lysine residue).

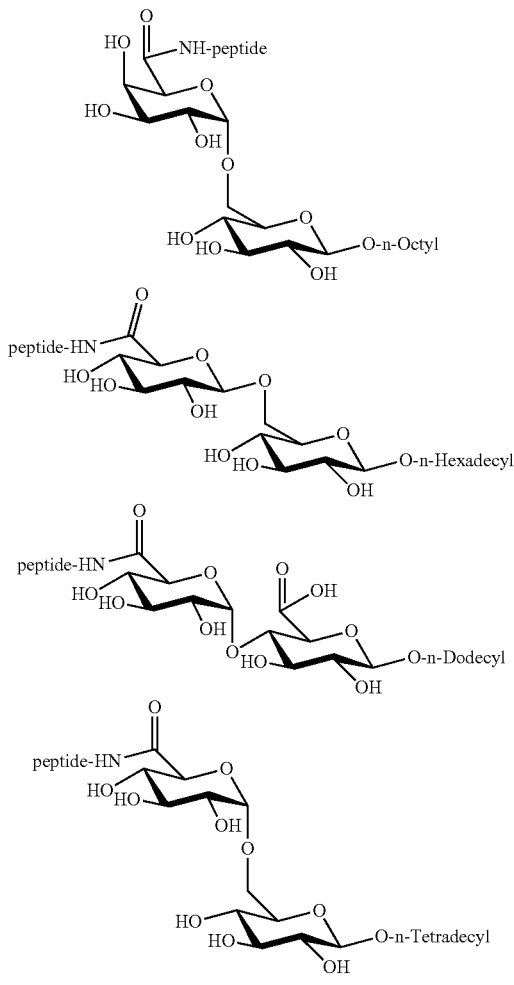

In some embodiments, a surfactant moiety is attached to a linker amino acid U of the peptide via an amide bond.

The peptide of a peptide product can be covalently attached to one or more surfactant moieties. In certain embodiments, a peptide product has one surfactant moiety. In further embodiments, a peptide product has two surfactant moieties, which can be the same or different. In other embodiments, a peptide product has three surfactant moieties, which can be the same or different.

A linker amino acid U can be any natural or unnatural amino acid that has a functional group suitable for covalent attachment to a surfactant moiety. In some embodiments, U is a dibasic natural or unnatural amino acid (e.g., one having a side-chain amino group such as lysine or ornithine), a diacidic natural or unnatural amino acid (e.g., one having a side-chain carboxyl group such as glutamic acid or aspartic acid), a natural or unnatural amino acid having a thiol/sulfhydryl group (e.g., cysteine), a natural or unnatural amino acid having a hydroxyl group (e.g., serine or threonine), or an unnatural amino acid having an $-N_3$ group, an acetylenic group, a haloacetyl group (e.g., $-NHC(=O)CH_2Br$) or a $-(CH_2)_m$-maleimide group, wherein m is 1-10. A haloacetyl group or a maleimide group of a linker amino acid can couple with, e.g., a thiol group of a saccharide group of the surfactant moiety, or vice versa. An azide group or an alkyne group of a linker amino acid can do a 1,3-dipolar cycloaddition with an alkyne group or an azide group, respectively, of a saccharide group of the surfactant moiety using a copper catalyst, for example, to form a triazole. In certain embodiments, U is a lysine, ornithine (Orn), cysteine or glutamic acid residue. Like any amino acid residue of the peptide, U can be an L- or D-amino acid.

A linker amino acid U can be an internal or/and a terminal amino acid residue of the peptide. The functional group of U that forms a covalent bond with a surfactant moiety can be a side-chain functional group of an internal or terminal amino acid residue, or can be the alpha amino group of the N-terminal amino acid residue or the alpha carboxyl group of the C-terminal amino acid residue.

In some embodiments, side-chain functional groups of two amino acid residues (denoted with an asterisk), such as a lysine residue and a glutamic acid residue, of the peptide are linked to form a cyclic structure, such as a lactam. A lactam formed between the side-chain functional groups of a lysine residue and a glutamic acid residue can stabilize the α-helical structure of a peptide. A cyclic structure can also be formed by a disulfide bond between the thiol group of two cysteine residues, which can restrict conformation and promote α-helix formation. A "click reaction" between the side-chain azide and alkyne groups of two unnatural amino acid residues can also form a heterocyclic structure (a triazole) that restricts conformation and stabilizes an α-helix (Le Chevalier et al., *J. Peptide Sci.*, 15:451-454 [2009]). Furthermore, the side-chain alkene groups of two unnatural amino acid residues can cyclize by olefin metathesis to form a C=C double bond, which can then be reduced to a C—C single bond (Verdine and Hilinski, *Meth. Enzymol.*, 503:3-33 [2011]).

In some embodiments, peptide products of Formula I-A comprise at least amino acid residues $aa_1$-$aa_{17}$, $aa_1$-$aa_{19}$, $aa_1$-$aa_{19}$ or $aa_1$-$aa_{20}$ of SEQ. ID. NO. 1108. In further embodiments, peptide products of Formula I-A comprise at least amino acid residues $aa_1$-$aa_{27}$, $aa_1$-$aa_{28}$, $aa_1$-$aa_{29}$ or $aa_1$-$aa_{30}$ of SEQ. ID. NO. 1108.

In some embodiments, peptide products of Formula I-A have Formula III-A:

Formula III-A
(SEQ. ID. NO. 1109)
$aa_1-aa_2-aa_3-aa_4-aa_5-aa_6-aa_7-aa_8-aa_9-aa_{10}-aa_{11}-$ $aa_{12}-aa_{13}-aa_{14}-aa_{15}-aa_{16}-aa_{17}-aa_{18}-aa_{19}-aa_{20}-$ $aa_{21}-aa_{22}-aa_{23}-aa_{24}-aa_{25}-aa_{26}-aa_{27}-aa_{28}-aa_{29}-Z$ wherein:
- Z is —OH or —NHR$^3$, wherein R$^3$ is H, unsubstituted or substituted C$_1$-C$_{12}$ alkyl, or a PEG-containing group of less than 10 Da;
- $aa_1$ is His, N(R$^3$)His, N(Ac)His, or pGlu-His;
- $aa_2$ is Ser, Ala, Gly, MePro, Aib, Ac4c or Ac5c;
- $aa_3$ is Gln or Cit;
- $aa_4$ is Gly or D-Ala;
- $aa_5$ is Thr or Ser;
- $aa_6$ is Phe, Trp, 2FPhe, MePhe, 2FMePhe or Nal2;
- $aa_7$ is Thr or Ser;
- $aa_8$ is Ser or Asp;
- $aa_9$ is Asp or Glu;
- $aa_{10}$ is Tyr, Leu, Met, Nal2, Bip, Bip2EtMeO, Glu, Lys or U(X);
- $aa_{11}$ is absent or Ser, Asn, Bip or U(X);
- $aa_{12}$ is absent or Lys, Glu, Ser, Arg or U(X);
- $aa_{13}$ is absent or Tyr, Gln, Cit or U(X);
- $aa_{14}$ is absent or Leu, Met, Nle, Glu, Lys or U(X);
- $aa_{15}$ is absent or Asp, Glu or U(X);
- $aa_{16}$ is absent or Ser, Gly, Glu, Ala, Aib, Ac5c, Lys, Arg or U(X);
- $aa_{17}$ is absent or Arg, hArg, Gln, Glu, Lys, Cit, Aib, Ac4c, Ac5c or U(X);
- $aa_{18}$ is absent or Arg, hArg, Ala, Aib, Ac4c, Ac5c or U(X);
- $aa_{19}$ is absent or Ala, Val, Aib, Ac4c, Ac5c or U(X);
- $aa_{20}$ is absent or Gln, Lys, Arg, Cit, Glu, Aib, Ac4c, Ac5c or U(X);
- $aa_{21}$ is absent or Asp, Glu, Leu, Aib, Ac4c, Ac5c or U(X);
- $aa_{22}$ is absent or Phe, Trp, Nal2, Aib, Ac4c, Ac5c or U(X);
- $aa_{23}$ is absent or Val, Ile, Aib, Ac4c, Ac5c or U(X);
- $aa_{24}$ is absent or Ala, Gln, Glu, Cit or U(X);
- $aa_{25}$ is absent or Trp, Nal2 or U(X);
- $aa_{26}$ is absent or Leu or U(X);
- $aa_{27}$ is absent or Met, Val, Leu, Nle, Lys or U(X);
- $aa_{28}$ is absent or Asn, Lys, Glu, Gln or U(X);
- $aa_{29}$ is absent or Thr, Gly, Aib, Ac4c, Ac5c or U(X);
- any two of $aa_1$-$aa_{29}$ can optionally be cyclized through their side chains to form a lactam; and
- provided that one, or at least one, of $aa_{10}$-$aa_{12}$ and $aa_{16}$-$aa_{29}$ is a natural or unnatural amino acid U covalently attached to a surfactant X.

In certain embodiments, peptide products of Formula III-A have the structure:

Formula III-A
(SEQ. ID. NO. 1110)
$aa_1-aa_2-aa_3-aa_4-aa_5-aa_6-aa_7-aa_8-aa_9-aa_{10}-aa_{11}-$ $aa_{12}-aa_{13}-aa_{14}-aa_{15}-aa_{16}-aa_{17}-aa_{18}-aa_{19}-aa_{20}-$ $aa_{21}-aa_{22}-aa_{23}-aa_{24}-aa_{25}-aa_{26}-aa_{27}-aa_{28}-aa_{29}-Z$ wherein:
- Z is —OH or —NHR$^3$, wherein R$^3$ is H, unsubstituted or substituted C$_1$-C$_{12}$ alkyl, or a PEG-containing group of less than 10 Da;
- $aa_1$ is His;
- $aa_2$ is Aib;
- $aa_3$ is Gln;
- $aa_4$ is Gly;
- $aa_5$ is Thr;
- $aa_6$ is Phe;
- $aa_7$ is Thr;
- $aa_8$ is Ser;
- $aa_9$ is Asp;
- $aa_{10}$ is Tyr, Glu, Lys or U(X);
- $aa_{11}$ is Ser;
- $aa_{12}$ is Lys or Glu;
- $aa_{13}$ is Tyr;
- $aa_{14}$ is Leu, Glu or Lys;
- $aa_{15}$ is Asp;
- $aa_{16}$ is Glu or Lys;
- $aa_{17}$ is Gln, Glu or U(X);
- $aa_{18}$ is Ala;
- $aa_{19}$ is Ala;
- $aa_{20}$ is Glu, Lys or U(X);
- $aa_{21}$ is Glu;
- $aa_{22}$ is Phe;
- $aa_{23}$ is Ile;
- $aa_{24}$ is Gln, Glu or U(X);
- $aa_{25}$ is Trp;
- $aa_{26}$ is Leu;
- $aa_{27}$ is Leu;
- $aa_{28}$ is Glu or Gln;
- $aa_{29}$ is Thr;
- $aa_{10}$ and $aa_{14}$, or $aa_{12}$ and $aa_{16}$, or $aa_{16}$ and $aa_{20}$ can optionally be cyclized through their side chains to form a lactam; and
- provided that one, or at least one, of $aa_{10}$, $aa_{17}$, $aa_{20}$ and $aa_{24}$ is a natural or unnatural amino acid U covalently attached to a sufactant X.

In further embodiments, peptide products of Formula I-A have Formula III-B:

(SEQ. ID. NO. 1111)
$His_1-aa_2-aa_3-Gly_4-Thr_5-aa_6-Thr_7-Ser_8-Asp_9-aa_{10}-aa_{11}-$ $aa_{12}-aa_{13}-aa_{14}-aa_{15}-aa_{16}-aa_{17}-aa_{18}-aa_{19}-aa_{20}-aa_{21}-aa_{22}-$ $aa_{23}-aa_{24}-aa_{25}-aa_{26}-aa_{27}-aa_{28}-aa_{29}-aa_{30}-Z$ Formula III-B wherein:
- Z is —OH or —NHR$^3$, wherein R$^3$ is H, unsubstituted or substituted C$_1$-C$_{12}$ alkyl, or a PEG-containing group of less than 10 Da;
- $aa_2$ is Gly, MePro or Aib;
- $aa_3$ is Gln or Cit;
- $aa_6$ is Phe, 2FPhe, MePhe, 2FMePhe or Nal2;
- $aa_{10}$ is Tyr, Nal2, Bip, Bip2EtMeO, Glu, Lys or U(X);
- $aa_{11}$ is absent or Ser, Asn, Bip or U(X);
- $aa_{12}$ is absent or Lys, Glu, Ser or U(X);
- $aa_{13}$ is absent or Tyr, Gln, Cit or U(X);
- $aa_{14}$ is absent or Leu, Nle, Glu, Lys or U(X);
- $aa_{15}$ is absent or Asp, Glu or U(X);
- $aa_{16}$ is absent or Ser, Gly, Glu, Ala, Aib, Lys, Arg or U(X);
- $aa_{17}$ is absent or Arg, hArg, Gln, Glu, Lys, Cit, Aib or U(X);
- $aa_{18}$ is absent or Arg, hArg, Ala, Aib, Ac4c, Ac5c or U(X);
- $aa_{19}$ is absent or Ala, Aib or U(X);
- $aa_{20}$ is absent or Gln, Lys, Arg, Cit, Glu, Aib or U(X);
- $aa_{21}$ is absent or Asp, Glu, Leu, Aib or U(X);
- $aa_{22}$ is absent or Phe or U(X)
- $aa_{23}$ is absent or Val, Ile, Aib or U(X);

aa$_{24}$ is absent or Ala, Glu, Gln or U(X);
aa$_{25}$ is absent or Trp or U(X);
aa$_{26}$ is absent or Leu or U(X);
aa$_{27}$ is absent or Met, Val, Leu, Nle, Lys or U(X);
aa$_{28}$ is absent or Asn, Glu, Gln, Cit or U(X);
aa$_{29}$ is absent or Thr, Aib or U(X);
aa$_{30}$ is absent or Arg or U(X);
any two of aa$_1$-aa$_{23}$ can optionally be cyclized via their side chains to form a lactam; and
provided that one, or at least one, of aa$_{10}$-aa$_{12}$, aa$_{16}$-aa$_{24}$ and aa$_{28}$ is a natural or unnatural amino acid U covalently attached to a surfactant X.

In some embodiments of peptide products of Formula I-A, III-A or III-B:
aa$_2$ is Gly, Aib or Ac4c; or
aa$_{12}$ is lysine; or
aa$_{14}$ is leucine; or
aa$_{17}$ is glycine or homoarginine (hArg); or
aa$_{17}$, aa$_{18}$, aa$_{20}$, aa$_{24}$ or aa$_{28}$, or any combination thereof, is lysine attached to a surfactant X; or
aa$_{16}$ and aa$_{20}$ are cyclized through their side chains to form a lactam; or
the surfactant X comprises an unsubstituted or substituted dodecyl, tetradecyl, hexadecyl or octadecyl alkyl group; or
any combination or all of the above.

In some embodiments, the peptide of peptide products described herein comprises one or more Aib residues at or near the N-terminus, at or near the C-terminus or internally, or any combination or all thereof. An Aib residue can protect the peptide from degradation by proteases such as dipeptidyl peptidase 4 (DPP-4). In certain embodiments, aa$_2$ is Aib.

In some embodiments, peptide products of Formula I-A, III-A or III-B have the structure:

(SEQ. ID. NO. 1126)
His$_1$-aa$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-aa$_{16}$-aa$_{17}$-Ala$_{18}$-

Ala$_{19}$-aa$_{20}$-Glu$_{21}$-Phe$_{22}$-aa$_{23}$-aa$_{24}$-Trp$_{25}$-Leu$_{26}$-aa$_{27}$- aa$_{28}$-Thr$_{29}$-NH$_2$ wherein:
aa$_2$ is Gly or Aib;
aa$_{16}$ is Glu, Ser, Ala, Lys or Aib;
aa$_{17}$ is Gln, Lys or U(X);
aa$_{20}$ is Lys, Glu or Arg;
aa$_{23}$ is Ile or Val;
aa$_{24}$ is Ala, Gln or U(X);
aa$_{27}$ is Met, Val or Leu; and
aa$_{28}$ is Asn, Gln or U(X).

In other embodiments, peptide products of Formula I-A, III-A or III-B have the structure:

(SEQ. ID. NO. 1127)
His$_1$-aa$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-aa$_{16}$-aa$_{17}$-Arg$_{18}$-

Ala$_{19}$-aa$_{20}$-Asp$_{21}$-Phe$_{22}$-aa$_{23}$-aa$_{24}$-Trp$_{25}$-Leu$_{26}$-aa$_{27}$- aa$_{28}$-Thr$_{29}$-NH$_2$ wherein:
aa$_2$ is Gly or Aib;
aa$_{16}$ is Glu, Ala or Aib;
aa$_{17}$ is Arg, hArg or Gln;
aa$_{20}$ is U(X) [e.g., Lys(X)];
aa$_{23}$ is Ile or Val;
aa$_{24}$ is Gln or Ala;
aa$_{27}$ is Leu or Val; and
aa$_{28}$ is Asn or Gln.

In other embodiments, peptide products of Formula I-A, III-A or III-B have the structure:

(SEQ. ID. NO. 774)
His$_1$-aa$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-aa$_{16}$-aa$_{17}$-Ala$_{18}$-

Ala$_{19}$-aa$_{20}$-Glu$_{21}$-Phe$_{22}$-aa$_{23}$-aa$_{24}$-Trp$_{25}$-Leu$_{26}$-aa$_{27}$- aa$_{28}$-Thr$_{29}$-NH$_2$ wherein:
aa$_2$ is Gly or Aib;
aa$_{16}$ is Glu, Ser, Ala, Lys or Aib;
aa$_{17}$ is Gln, Glu, Lys or U(X);
aa$_{20}$ is Lys, Glu or Arg;
aa$_{23}$ is Ile or Val;
aa$_{24}$ is Ala, Gln or U(X);
aa$_{27}$ is Met, Val or Leu; and
aa$_{28}$ is Asn, Gln or U(X).

In other embodiments, peptide products of Formula I-A, III-A or III-B have the structure:

(SEQ. ID. NO. 775)
His$_1$-aa$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-aa$_{16}$-aa$_{17}$-Ala$_{18}$-

Ala$_{19}$-Lys$_{20}$-Glu$_{21}$-Phe$_{22}$-Ile$_{23}$-Gln$_{24}$-Trp$_{25}$-Leu$_{26}$- aa$_{27}$-Asn$_{28}$-Thr$_{29}$-NH$_2$ wherein:
aa$_2$ is Gly or Aib;
aa$_{16}$ is Glu, Ala or Aib;
aa$_{17}$ is U(X) [e.g., Lys(X)]; and
aa$_{27}$ is Leu or Val.

In other embodiments, peptide products of Formula I-A, III-A or III-B have the structure:

(SEQ. ID. NO. 776)
His$_1$-aa$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-aa$_{16}$-aa$_{17}$-Arg$_{18}$-

Ala$_{19}$-aa$_{20}$-Asp$_{21}$-Phe$_{22}$-aa$_{23}$-aa$_{24}$-Trp$_{25}$-Leu$_{26}$-aa$_{27}$- aa$_{28}$-Thr$_{29}$-NH$_2$ wherein:
aa$_2$ is Gly or Aib;
aa$_{16}$ is Glu, Ser, Ala or Aib;
aa$_{17}$ is Arg, hArg or Gln,
aa$_{20}$ is Lys or U(X);
aa$_{23}$ is Ile or Val;
aa$_{24}$ is Ala, Gln or U(X);
aa$_{27}$ is Leu or Val; and
aa$_{28}$ is Asn, Gln or U(X).

In other embodiments, peptide products of Formula I-A, III-A or III-B have the structure:

(SEQ. ID. NO. 777)
His$_1$-aa$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-aa$_{16}$-aa$_{17}$-Arg$_{18}$-

Ala$_{19}$-aa$_{20}$-Asp$_{21}$-Phe$_{22}$-aa$_{23}$-aa$_{24}$-Trp$_{25}$-Leu$_{26}$-aa$_{27}$- aa$_{28}$-Thr$_{29}$-NH$_2$ wherein:
aa$_2$ is Gly or Aib;
aa$_{16}$ is Glu, Ser, Ala or Aib;
aa$_{17}$ is Arg, hArg or Gln,
aa$_{20}$ is Lys or U(X);
aa$_{23}$ is Ile or Val;
aa$_{24}$ is Gln, Ala or U(X);
aa$_{27}$ is Leu or Val; and
aa$_{28}$ is Asn, Gln or U(X).

In other embodiments, peptide products of Formula I-A, III-A or III-B have the structure:

(SEQ. ID. NO. 778)
His$_1$-aa$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-aa$_{16}$*-aa$_{17}$-Ala$_{18}$-

Ala$_{19}$-aa$_{20}$*-Glu$_{21}$-Phe$_{22}$-Ile$_{23}$-Lys(N-omega-X)$_{24}$-

Trp$_{25}$-Leu$_{26}$-aa$_{27}$-aa$_{28}$-Thr$_{29}$-NH$_2$ wherein:
aa$_2$ is Aib or Gly;
aa$_{16}$* and aa$_{20}$* independently are Lys or Glu and are cyclized through their side chains to form a lactam;
aa$_{17}$ is Arg, hArg or Gln;
aa$_{27}$ is Met, Val, Leu or Nle; and
aa$_{28}$ is Asn or Gln.

In some embodiments, the surfactant X is 1'-alkyl beta-D-glucuronyl. In certain embodiments, the alkyl group is linear C—C$_{20}$ alkyl.

In other embodiments, peptide products of Formula I-A, III-A or III-B have the structure:
wherein:

(SEQ. ID. NO. 779)
His$_1$-aa$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-aa$_{16}$-aa$_{17}$-Ala$_{18}$-

Ala$_{19}$-Lys$_{20}$-Glu$_{21}$-Phe$_{22}$-Ile$_{23}$-Ala$_{24}$-Trp$_{25}$-Leu$_{26}$-

Leu$_{27}$-Asn$_{28}$-Thr$_{29}$-NH$_2$ aa$_2$ is Aib or Gly;
aa$_{16}$ is Glu, Ala or Aib; and
aa$_{17}$ is Lys(N-omega-X).

In some embodiments, the surfactant X is 1'-alkyl beta-D-glucuronyl. In certain embodiments, the alkyl group is linear C$_8$-C$_{20}$ alkyl.

In other embodiments, peptide products of Formula I-A, III-A or III-B have the structure:

(SEQ. ID. NO. 780)
His$_1$-aa$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-aa$_{16}$-aa$_{17}$-Arg$_{18}$-

Ala$_{19}$-aa$_{20}$-Asp$_{21}$-Phe$_{22}$-aa$_{23}$-aa$_{24}$-Trp$_{25}$-Leu$_{26}$-aa$_{27}$- aa$_{28}$-Thr$_{29}$-NH$_2$ wherein:
aa$_2$ is Gly or Aib;
aa$_{16}$ is Glu, Ala or Aib;
aa$_{17}$ is Arg or hArg;
aa$_{20}$ is Lys(N-omega-X);
aa$_{23}$ is Ile or Val;
aa$_{24}$ is Gln or Ala;
aa$_{27}$ is Leu or Val; and
aa$_{28}$ is Asn or Gln.

In some embodiments, the surfactant X is 1'-alkyl beta-D-glucuronyl. In certain embodiments, the alkyl group is linear C$_8$-C$_{20}$ alkyl.

In other embodiments, peptide products of Formula I-A, III-A or III-B have the structure:

(SEQ. ID. NO. 781)
His$_1$-aa$_2$-Gln$_3$-Gly$_4$-Thr$_5$-aa$_6$-Thr$_7$-Ser$_8$-Asp$_9$-aa$_{10}$- aa$_{11}$-Z wherein:
aa$_2$ is Gly, Aib or MePro;
aa$_6$ is Phe, 2FPhe, MePhe or 2FMePhe;
aa$_{10}$ is Tyr, Nal2, Bip, Bip2Et or Bip2EtMeO; and
aa$_{11}$ is Lys(N-omega-X).

In some embodiments, the surfactant X is 1'-alkyl beta-D-glucuronyl. In certain embodiments, the alkyl group is linear C$_8$-C$_{20}$ alkyl.

In other embodiments, peptide products of Formula I-A, III-A or III-B have the structure:

(SEQ. ID. NO. 795)
His$_1$-aa$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-Glu$_{16}$-U(X)$_{17}$-Ala$_{18}$-

Ala$_{19}$-Lys$_{20}$-Glu$_{21}$-Phe$_{22}$-Ile$_{23}$-Gln$_{24}$-Trp$_{25}$-Leu$_{26}$-

Leu$_{27}$-aa$_{28}$-Thr$_{29}$-NH$_2$ wherein:
aa$_2$ is Gly or Aib; and
aa$_{28}$ is Asn or Gln.

In other embodiments, peptide products of Formula I-A, III-A or III-B have the structure:

(SEQ. ID. NO. 796)
His$_1$-Aib$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-aa$_{16}$*-Gln$_{17}$-Ala$_{18}$-Ala$_{19}$- aa$_{20}$*-Glu$_{21}$-Phe$_{22}$-Ile$_{23}$-Lys(N-omega-X)$_{24}$-Trp$_{25}$-Leu$_{26}$-

Leu$_{27}$-aa$_{28}$-Thr$_{29}$-NH$_2$ wherein:
 aa$_{16}$* and aa$_{20}$* independently are Lys or Glu and are cyclized through their side chains to form a lactam;
 aa$_{28}$ is Asn or Gln; and
 the surfactant X comprises a 1-alkyl beta-D-glucoside, 1-alkyl beta-D-maltoside, 1-alkyl beta-D-melibioside or the like, or the corresponding alpha anomer, wherein alkyl is linear C$_8$-C$_{20}$ alkyl.

In other embodiments, peptide products of Formula I-A, III-A or III-B have the structure:

(SEQ. ID. NO. 797)
His$_1$-Aib$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-Glu$_{16}$*-Gln$_{17}$-Ala$_{18}$-Ala$_{19}$-

Lys$_{20}$*-Glu$_{21}$-Phe$_{22}$-Ile$_{23}$-Lys(N-omega-X)$_{24}$-Trp$_{25}$-Leu$_{26}$-

Leu$_{27}$-Gln$_{28}$-Thr$_{29}$-NH$_2$ wherein:
 Glu$_{16}$* and Lys$_{20}$* are cyclized through their side chains to form a lactam; and
 the surfactant X comprises a 1-alkyl beta-D-glucoside, 1-alkyl beta-D-maltoside, 1-alkyl beta-D-melibioside or the like, or the corresponding alpha anomer, wherein alkyl is linear C$_8$-C$_{20}$ alkyl.

In other embodiments, peptide products of Formula I-A, III-A or III-B have the structure:

(SEQ. ID. NO. 1025)
His$_1$-Aib$_2$-Gln$_3$-Gly$_4$-Thr$_5$-Phe$_6$-Thr$_7$-Ser$_8$-Asp$_9$-U(X)$_{10}$-

Ser$_{11}$-Lys$_{12}$-Tyr$_{13}$-Leu$_{14}$-Asp$_{15}$-aa$_{16}$*-aa$_{17}$-Ala$_{18}$-Ala$_{19}$- aa$_{20}$*-Glu$_{21}$-Phe$_{22}$-Ile$_{23}$-aa$_{24}$-Trp$_{25}$-Leu$_{26}$-Leu$_{27}$-aa$_{28}$-

Thr$_{29}$-Z wherein:
 Z is —OH or —NHR$^3$, wherein R$^3$ is H or a PEG-containing group of less than 10 Da;
 aa$_{16}$* and aa$_{20}$* independently are Lys or Glu and are cyclized through their side chains to form a lactam;
 aa$_{17}$ is Glu or Gln;
 aa$_{24}$ is Ala, Glu or Gln; and
 aa$_{28}$ is Asn or Gln.

In other embodiments, peptide products of Formula I-A, III-A or III-B have the structure:

(SEQ. ID. NO. 1026)
His$_1$-Aib$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-aa$_{16}$*-U(X)$_{17}$-Ala$_{18}$-Ala$_{19}$- aa$_{20}$*-Glu$_{21}$-Phe$_{22}$-Ile$_{23}$-aa$_{24}$-Trp$_{25}$-Leu$_{26}$-Leu$_{27}$-aa$_{28}$-

Thr$_{29}$-Z wherein:
 Z is —OH or —NHR$^3$, wherein R$^3$ is H or a PEG-containing group of less than 10 Da;
 aa$_{16}$* and aa$_{20}$* independently are Lys or Glu and are cyclized through their side chains to form a lactam;
 aa$_{24}$ is Ala, Glu or Gln; and
 aa$_{28}$ is Asn or Gln.

In other embodiments, peptide products of Formula I-A, III-A or III-B have the structure:

(SEQ. ID. NO. 1027)
His$_1$-Aib$_2$-Gln$_3$-Gly$_4$-Thr$_5$-Phe$_6$-Thr$_7$-Ser$_8$-Asp$_9$-aa$_{10}$*-

Ser$_{11}$-Lys$_{12}$-Tyr$_{13}$-aa$_{14}$*-Asp$_{15}$-Ser$_{16}$-aa$_{17}$-Ala$_{18}$-Ala$_{19}$-

U(X)$_{20}$-Glu$_{21}$-Phe$_{22}$-Ile$_{23}$-aa$_{24}$-Trp$_{25}$-Leu$_{26}$-Leu$_{27}$-aa$_{28}$-

Thr$_{29}$-Z wherein:
 Z is —OH or —NHR$^3$, wherein R$^3$ is H or a PEG-containing group of less than 10 Da;
 aa$_{10}$* and aa$_{14}$* independently are Lys or Glu and are cyclized through their side chains to form a lactam;
 aa$_{17}$ is Glu or Gln;
 aa$_{24}$ is Ala, Glu or Gln; and
 aa$_{28}$ is Asn or Gln.

In other embodiments, peptide products of Formula I-A, III-A or III-B have the structure:

(SEQ. ID. NO. 1028)
His$_1$-Aib$_2$-Gln$_3$-Gly$_4$-Thr$_5$-Phe$_6$-Thr$_7$-Ser$_8$-Asp$_9$-Tyr$_{10}$-

Ser$_{11}$-aa$_{12}$*-Tyr$_{13}$-Gln$_{14}$-Asp$_{15}$-aa$_{16}$*-aa$_{17}$-Ala$_{18}$-Ala$_{19}$-

U(X)$_{20}$-Glu$_{21}$-Phe$_{22}$-Ile$_{23}$-aa$_{24}$-Trp$_{25}$-Leu$_{26}$-Leu$_{27}$-aa$_{28}$-

Thr$_{29}$-Z wherein:
 Z is —OH or —NHR$^3$, wherein R$^3$ is H or a PEG-containing group of less than 10 Da;
 aa$_{12}$* and aa$_{16}$* independently are Lys or Glu and are cyclized through their side chains to form a lactam;
 aa$_{17}$ is Glu or Gln;
 aa$_{24}$ is Ala, Glu or Gln; and
 aa$_{28}$ is Asn or Gln.

In other embodiments, peptide products of Formula I-A, III-A or III-B have the structure:

(SEQ. ID. NO. 1029)
His$_1$-Aib$_2$-Gln$_3$-Gly$_4$-Thr$_5$-Phe$_6$-Thr$_7$-Ser$_8$-Asp$_9$-Tyr$_{10}$-

Ser$_{11}$-Lys$_{12}$-Tyr$_{13}$-Leu$_{14}$-Asp$_{15}$-aa$_{16}$*-Gln$_{17}$-Ala$_{18}$-Ala$_{19}$- aa$_{20}$*-Glu$_{21}$-Phe$_{22}$-Ile$_{23}$-U(X)$_{24}$-Trp$_{25}$-Leu$_{26}$-Leu$_{27}$-aa$_{28}$-

Thr$_{29}$-Z wherein:
 Z is —OH or —NHR$^3$, wherein R$^3$ is H or a PEG-containing group of less than 10 Da;
 aa$_{16}$* and aa$_{20}$* independently are Lys or Glu and are cyclized through their side chains to form a lactam;
 aa$_{28}$ is Asn or Gln; and
 the surfactant X comprises a 1-alkyl beta-D-glucoside, 1-alkyl beta-D-maltoside, 1-alkyl beta-D-melibioside or the like, or the corresponding alpha anomer, wherein alkyl is linear C$_8$-C$_{20}$ alkyl.

In other embodiments, peptide products of Formula I-A, III-A or III-B have the structure:

(SEQ. ID. NO. 1113)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu$_{16}$*-Gln$_{17}$-Ala$_{18}$-Ala$_{19}$-Lys$_{20}$*-Glu$_{21}$-Phe$_{22}$-Ile$_{23}$-Lys(N-omega-X)$_{24}$-Trp$_{25}$-Leu$_{26}$-Leu$_{27}$-Gln$_{28}$-Thr$_{29}$-Z wherein:

Z is —OH or —NHR$^3$;

Glu$_{16}$* and Lys$_{20}$* are cyclized through their side chains to form a lactam; and the surfactant X comprises a 1-alkyl beta-D-glucoside, 1-alkyl beta-D-maltoside, 1-alkyl beta-D-melibioside or the like, or the corresponding alpha anomer, wherein alkyl is linear C$_8$-C$_{20}$ alkyl.

In some embodiments, a peptide product has the structure:

(SEQ. ID. NO. 601)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu$_{16}$*-Gln$_{17}$-Ala$_{18}$-Ala$_{19}$-Lys$_{20}$*-Glu$_{21}$-Phe$_{22}$-Ile$_{23}$-Lys(N-omega[1-dodecyl beta-D-glucuronyl])$_{24}$-Trp$_{25}$-Leu$_{26}$-Leu$_{27}$-Gln$_{28}$-Thr$_{29}$-NH$_2$;

(SEQ. ID. NO. 602)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu$_{16}$*-Gln$_{17}$-Ala$_{18}$-Ala$_{19}$-Lys$_{20}$*-Glu$_{21}$-Phe$_{22}$-Ile$_{23}$-Lys(N-omega[1-tetradecyl beta-D-glucuronyl])$_{24}$-Trp$_{25}$-Leu$_{26}$-Leu$_{27}$-Gln$_{28}$-Thr$_{29}$-NH$_2$;

(SEQ. ID. NO. 603)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu$_{16}$*-Gln$_{17}$-Ala$_{18}$-Ala$_{19}$-Lys$_{20}$*-Glu$_{21}$-Phe$_{22}$-Ile$_{23}$-Lys(N-omega[1-hexadecyl beta-D-glucuronyl])$_{24}$-Trp$_{25}$-Leu$_{26}$-Leu$_{27}$-Gln$_{28}$-Thr$_{29}$-NH$_2$;

(SEQ. ID. NO. 604)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu$_{16}$*-Gln$_{17}$-Ala$_{18}$-Ala$_{19}$-Lys$_{20}$*-Glu$_{21}$-Phe$_{22}$-Ile$_{23}$-Lys(N-omega[1-octadecyl beta-D-glucuronyl])$_{24}$-Trp$_{25}$-Leu$_{26}$-Leu$_{27}$-Gln$_{28}$-Thr$_{29}$-NH$_2$;

(SEQ. ID. NO. 630)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-omega[1-octyl beta-D-melibiouronyl])$_{24}$-Trp$_{25}$-Leu$_{26}$-Leu$_{27}$-Gln$_{28}$-Thr$_{29}$-NH$_2$;

(SEQ. ID. NO. 631)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-omega[1-dodecyl beta-D-melibiouronyl]$_{24}$-Trp$_{25}$-Leu$_{26}$-Leu$_{27}$-Gln$_{28}$-Thr$_{29}$-NH$_2$;

(SEQ. ID. NO. 632)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-Omega[1-tetradecyl beta-D-melibiouronyl])$_{24}$-Trp$_{25}$-Leu$_{26}$-Leu$_{27}$-Gln$_{28}$-Thr$_{29}$-NH$_2$;

(SEQ. ID. NO. 633)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-Omega[1-hexadecyl beta-D-melibiouronyl])$_{24}$-Trp$_{25}$-Leu$_{26}$-Leu$_{27}$-Gln$_{28}$-Thr$_{29}$-NH$_2$;

(SEQ. ID. NO. 634)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-Omega[1-octadecyl beta-D-melibiouronyl])$_{24}$-Trp$_{25}$-Leu$_{26}$-Leu$_{27}$-Gln$_{28}$-Thr$_{29}$-NH$_2$;

(SEQ. ID. NO. 805)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-Omega[1-hexadecyl alpha-D-melibiouronyl])$_{24}$-Trp$_{25}$-Leu$_{26}$-Leu$_{27}$-Gln$_{28}$-Thr$_{29}$-NH$_2$;

(SEQ. ID. NO. 819)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-tetradecyl alpha-D-melibiouronyl])$_{17}$-Ala$_{18}$-Ala$_{19}$-Lys*$_{20}$-Glu$_{21}$-Phe$_{22}$-Ile$_{23}$-Gln$_{24}$-Trp$_{25}$-Leu$_{26}$-Leu$_{27}$-Gln$_{28}$-Thr$_{29}$-NH$_2$;

(SEQ. ID. NO. 820)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-hexadecyl alpha-D-melibiouronyl]$_{17}$-Ala$_{18}$-Ala$_{19}$-Lys*$_{20}$-Glu$_{21}$-Phe$_{22}$-Ile$_{23}$-Gln$_{24}$-Trp$_{25}$-Leu$_{26}$-Leu$_{27}$-Gln$_{28}$-Thr$_{29}$-NH$_2$;

(SEQ. ID. NO. 821)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-octadecyl alpha-D-melibiouronyl])$_{17}$-Ala$_{18}$-Ala$_{19}$-Lys*$_{20}$-Glu$_{21}$-Phe$_{22}$-Ile$_{23}$-Gln$_{24}$-Trp$_{25}$-Leu$_{26}$-Leu$_{27}$-Gln$_{28}$-Thr$_{29}$-NH$_2$;

(SEQ. ID. NO. 1114)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-

-continued dodecyl alpha-D-melibiouronyl])$_{17}$-Ala$_{18}$-Ala$_{19}$-Lys*$_{20}$-Glu$_{21}$-Phe$_{22}$-Ile$_{23}$-Lys(N-omega[1-dodecyl beta-D-glucouronyl])$_{24}$-Trp$_{25}$-Leu$_{26}$-Leu$_{27}$-Gln$_{28}$-Thr$_{29}$-NH$_2$;

(SEQ. ID. NO. 1115)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-tetradecyl alpha-D-melibiouronyl])$_{17}$-Ala$_{18}$-Ala$_{19}$-Lys*$_{20}$-Glu$_{21}$-Phe$_{22}$-Ile$_{23}$-Lys(N-omega[1-tetradecyl beta-D-glucouronyl])$_{24}$-Trp$_{25}$-Leu$_{26}$-Leu$_{27}$-Gln$_{28}$-Thr$_{29}$-NH$_2$;

(SEQ. ID. NO. 1116)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-hexadecyl alpha-D-melibiouronyl])$_{17}$-Ala$_{18}$-Ala$_{19}$-Lys*$_{20}$-Glu$_{21}$-Phe$_{22}$-Ile$_{23}$-Lys(N-omega[1-hexadecyl beta-D-glucouronyl])$_{24}$-Trp$_{25}$-Leu$_{26}$-Leu$_{27}$-Gln$_{28}$-Thr$_{29}$-NH$_2$;

(SEQ. ID. NO. 1117)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-(13-carboxyl-tridecyloxy) beta-D-glucuronyl])$_{17}$-Ala$_{18}$-Ala$_{19}$-Lys*$_{20}$-Glu$_{21}$-Phe$_{22}$-Ile$_{23}$-Gln$_{24}$-Trp$_{25}$-Leu$_{26}$-Leu$_{27}$-Gln$_{28}$-Thr$_{29}$-NH$_2$;

(SEQ. ID. NO. 1118)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-(15-carboxyl-pentadecyloxy) beta-D-glucuronyl]$_{17}$-Ala$_{18}$-Ala$_{19}$-Lys*$_{20}$-Glu$_{21}$-Phe$_{22}$-Ile$_{23}$-Gln$_{24}$-Trp$_{25}$-Leu$_{26}$-Leu$_{27}$-Gln$_{28}$-Thr$_{29}$-NH$_2$;

(SEQ. ID. NO. 1119)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-(17-carboxyl-heptadecyloxy) beta-D-glucuronyl]$_{17}$-Ala$_{18}$-Ala$_{19}$-Lys*$_{20}$-Glu$_{21}$-Phe$_{22}$-Ile$_{23}$-Gln$_{24}$-Trp$_{25}$-Leu$_{26}$-Leu$_{27}$-Gln$_{28}$-Thr$_{29}$-NH$_2$;

(SEQ. ID. NO. 1120)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-omega[1-(13-carboxyl-tridecyloxy) beta-D-glucuronyl])$_{24}$-Trp$_{25}$-Leu$_{26}$-Leu$_{27}$-Gln$_{28}$-Thr$_{29}$-NH$_2$;

(SEQ. ID. NO. 1121)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-omega[1-(15-carboxyl-pentadecyloxy) beta-D-glucuronyl])$_{24}$-Trp$_{25}$-Leu$_{26}$-Leu$_{27}$-Gln$_{28}$-Thr$_{29}$-NH$_2$;

(SEQ. ID. NO. 1122)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-omega[1-(17-carboxyl-heptadecyloxy) beta-D-glucuronyl])$_{24}$-Trp$_{25}$-Leu$_{26}$-Leu$_{27}$-Gln$_{28}$-Thr$_{29}$-NH$_2$;

(SEQ. ID. NO. 1123)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-omega[1-(13-carboxyl-tridecyloxy) beta-D-melibiouronyl]$_{24}$-Trp$_{25}$-Leu$_{26}$-Leu$_{27}$-Gln$_{28}$-Thr$_{29}$-NH$_2$;

(SEQ. ID. NO. 1124)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-omega[1-(15-carboxyl-pentadecyloxy) beta-D-melibiouronyl])$_{24}$-Trp$_{25}$-Leu$_{26}$-Leu$_{27}$-Gln$_{28}$-Thr$_{29}$-NH$_2$;
or (SEQ. ID. NO. 1125)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-omega[1-(17-carboxyl-heptadecyloxy) beta-D-melibiouronyl]$_{24}$-Trp$_{25}$-Leu$_{26}$-Leu$_{27}$-Gln$_{28}$-Thr$_{29}$-NH$_2$;

or a pharmaceutically acceptable salt thereof, wherein Glu$_{16}$* and Lys$_{20}$* denote residues that are cyclized through their side chains to form a lactam.

Additional peptide products are described in Table 1 in FIG. 1, Table 2 in FIG. 2, Table 3 in FIG. 3, and Table 4 in FIG. 4.

FIG. 5 illustrates the x-ray crystal structure of the binding site of the N-terminal region/extracellular domain of the GLP-1 receptor and shows a critical hydrophobic ligand-binding region (Val$^{19}$*, Phe$^{22}$*, Trp$^{25}$* and Leu$^{26}$* of the ligand exendin-4, and the sequence of exendin-4 beyond Glu$_{15}$ interacts as an amphiphilic helix with this region). A 1-alkyl group of the surfactant moiety of a peptide product can engage in such a hydrophobic interaction with the GLP-1 receptor.

In some embodiments, a surfactant moiety is connected to a linker amino acid U of a peptide via a spacer. A spacer can increase the aqueous solubility of the peptide product and increase the flexibility of the peptide-surfactant attachment point. In certain embodiments, the spacer is an amino acid spacer containing one or more amino acids. In some embodiments, one occurrence of R$^2$ of surfactant X is an amino acid spacer used for attachment to the peptide. In certain embodiments, an amino acid spacer is Gly$_m$, Glu$_m$ or Lys$_m$, where m is an integer from 1 to 10. For example, W$^1$ can be —(C=O)— and R$^2$ can be a Gly$_m$ spacer that is joined via the carboxyl group of the terminal glycine residue, or a $Glu_m$ spacer that is joined via the alpha or gamma carboxyl group of the terminal glutamic acid residue, to the side-chain amino group of a lysine residue, or to the N-terminus, of the peptide, or $R^2$ can be a $Lys_m$ spacer that is joined via the carboxyl group of the terminal lysine residue to the side-chain amino group of a lysine residue, or to the N-terminus, of the peptide.

In other embodiments, the spacer is a hydrophilic spacer that does not contain an amino acid residue. For example, such a spacer can be

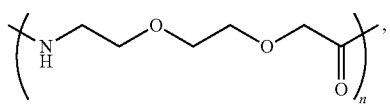

where n is 1, 2 or 3. The amino group of such a spacer can be joined to, e.g., a carboxyl group at the C-6 position of a saccharide of the surfactant moiety, and the carboxyl group of such a spacer can be joined to, e.g., a side-chain amino group of an amino acid (e.g., a lysine) residue or the N-terminus of the peptide.

Three examples of attachment of a surfactant moiety to a peptide via a spacer are shown below. The peptide is at the top, the spacer is in the middle and the surfactant comprising a $C_{12}$ alkyl group (denoted as "C12") is at the bottom. In the example on the left, the spacer is one ornithine residue, whose carboxyl group forms an amide bond with the side-chain amino group of a lysine residue of the peptide. In the example in the middle, the spacer is one glutamic acid residue, whose gamma carboxyl group forms an amide bond with the side-chain amino group of a lysine residue of the peptide. In the example on the right, the spacer comprises one glutamic acid residue.

S1 spacer

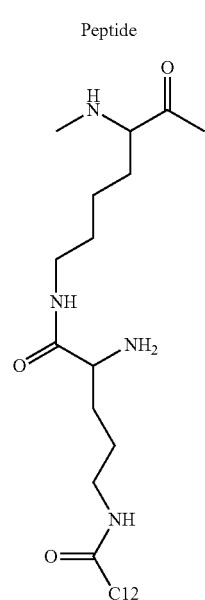

S2 spacer

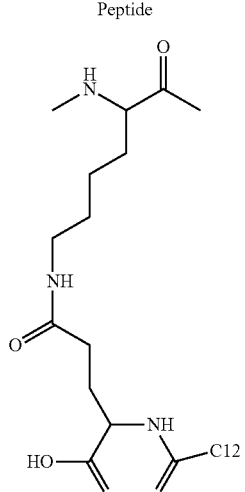

S3 spacer

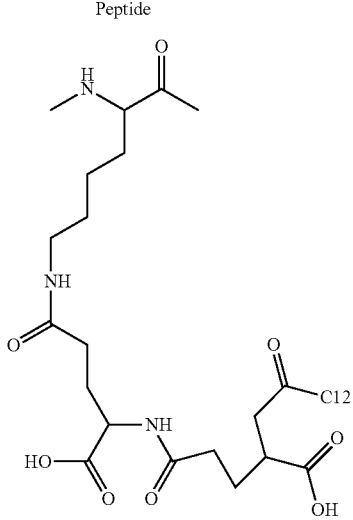

A peptide product can optionally have one or more additional modifications. Such modifications include without limitation acylation (e.g., acetylation) at the N-terminus, and attachment of a natural or synthetic polymer (e.g., a hydrophilic synthetic polymer such as polyethylene glycol [PEG], which can increase the aqueous solubility of the peptide product) or/and lipidation (e.g., acylation with a $C_8$-$C_{20}$ saturated or unsaturated fatty acid/di-acid or linkage to a steroid nucleus-containing group such as cholesterol) at the N-terminus, the C-terminus or/and one or more side chains.

The disclosure encompasses analogs and variants of the peptide products described herein. Such analogs and variants include without limitation those having a conservative substitution at one or more positions of the amino acid sequence of the specific peptide products disclosed herein. Reference to the peptide products described herein includes all pharmaceutically acceptable salts thereof.

Covalent attachment of a surfactant moiety to a peptide confers a unique combination of beneficial properties on the peptide products. The hydrophobic nature of the surfactant moiety promotes binding of the peptide-surfactant conjugates to hydrophobic carrier proteins such as human serum albumin (HSA), thereby increasing the half-life and duration of action of the peptide products via multiple mechanisms, including increased resistance to proteases and other types of hydrolytic enzymes, reduced renal clearance and slow release of the peptide products from the carrier proteins. Strong but reversible, non-covalent binding of the hydrophobic group of the surfactant moiety of the peptide products to a hydrophobic pocket of carrier proteins such as HSA (MW of about 67 kDa) shields the peptide products from proteases (e.g., DPP-4) and other types of degradative enzymes circulating in the blood and expressed on the surface of cells, renders the peptide products less immunogenic, and increases the molecular weight of the peptide products above the filtration threshold of about 60-70 kDa so that the peptide products avoid renal clearance via glomerular filtration into the urine. Furthermore, binding of the peptide products to HSA increases their half-life through pH-dependent HSA recycling mediated by the neonatal Fc receptor (FcRn). In some embodiments, the peptide products have a half-life (e.g., circulation half-life or/and elimination half-life) of at least about 3 days, 1 week, 10 days or 2 weeks (e.g., at least about 1 week).

In addition, the amphiphilic nature of the surfactant moiety containing a hydrophilic saccharide group and a hydrophobic group increases the bioavailability and duration of action of the peptide products. The surfactant moiety can disrupt the tight junction between cells in mucosal membranes, thereby facilitating penetration of the peptide products across mucosal barriers. The surfactant moiety can also form micelles, which can facilitate penetration of the peptide products through membranes. Moreover, the process of breaking up of the micelles can prolong the duration of action of the peptide products. A surfactant forms micelles when its concentration is greater than its critical micelle concentration (CMC), and alkyl glycosides having the same saccharide group tend to have a lower CMC the longer the alkyl chain.

With a greatly increased plasma and elimination half-life compared to the peptides not attached to a surfactant moiety, the peptide products themselves are pharmacological agents. In other words, the stable surfactant moiety remains attached to the peptide in vivo, and the intact peptide-surfactant conjugate can exert biological activity by binding to the receptor(s) of the underlying class of peptide. For example, peptide products disclosed herein can exert biological activity by binding to and activating the GLP-1 receptor (GLP1R) or/and the glucagon receptor (GCGR). In some embodiments, the peptide products are dual GLP1R/GCGR agonists. The potency or/and the selectivity of receptor binding or activation can be fine-tuned by varying the surfactant component or/and the peptide component.

Pharmaceutical Compositions

The disclosure also provides pharmaceutical compositions comprising a peptide product described herein or a pharmaceutically acceptable salt thereof, and one or more pharmaceutically acceptable carriers or excipients. A pharmaceutical composition contains a therapeutically effective amount of a peptide product or an appropriate fraction thereof. A composition can optionally contain an additional therapeutic agent. In some embodiments, a peptide product is at least about 90%, 95% or 98% pure.

Pharmaceutically acceptable excipients and carriers include pharmaceutically acceptable substances, materials and vehicles. Non-limiting examples of types of excipients include liquid and solid fillers, diluents, binders, lubricants, glidants, surfactants, dispersing agents, disintegration agents, emulsifying agents, wetting agents, suspending agents, thickeners, solvents, isotonic agents, buffers, pH adjusters, absorption-delaying agents, stabilizers, antioxidants, preservatives, antimicrobial agents, antibacterial agents, antifungal agents, chelating agents, adjuvants, sweetening agents, flavoring agents, coloring agents, encapsulating materials and coating materials. The use of such excipients in pharmaceutical formulations is known in the art. For example, conventional vehicles and carriers include without limitation oils (e.g., vegetable oils such as olive oil and sesame oil), aqueous solvents {e.g., saline, buffered saline (e.g., phosphate-buffered saline [PBS]) and isotonic solutions (e.g., Ringer's solution)}, and organic solvents (e.g., dimethyl sulfoxide and alcohols [e.g., ethanol, glycerol and propylene glycol]). Except insofar as any conventional excipient or carrier is incompatible with a peptide product, the disclosure encompasses the use of conventional excipients and carriers in formulations containing a peptide product. See, e.g., Remington: The Science and Practice of Pharmacy, 21st Ed., Lippincott Williams & Wilkins (Philadelphia, Pa.) (2005); Handbook of Pharmaceutical Excipients, 5th Ed., Rowe et al., Eds., The Pharmaceutical Press and the American Pharmaceutical Association (2005); Handbook of Pharmaceutical Additives, 3rd Ed., Ash and Ash, Eds., Gower Publishing Co. (2007); and Pharmaceutical Pre-formulation and Formulation, Gibson, Ed., CRC Press (Boca Raton, Fla.) (2004).

Appropriate formulation can depend on various factors, such as the route of administration chosen. Potential routes of administration of a pharmaceutical composition comprising a peptide product include without limitation oral, parenteral (including intradermal, subcutaneous, intramuscular, intravascular, intravenous, intra-arterial, intraperitoneal, intracavitary and topical), and topical (including transdermal, transmucosal, intranasal [e.g., by nasal spray or drop], ocular [e.g., by eye drop], pulmonary [e.g., by oral or nasal inhalation], buccal, sublingual, rectal [e.g., by suppository], and vaginal [e.g., by suppository]). In certain embodiments, a peptide product is administered parenterally (e.g., subcutaneously, intravenously or intramuscularly). In other embodiments, a peptide product is administered by oral inhalation or nasal inhalation or insufflation.

In some embodiments, the carrier is an aqueous-based carrier, such as in a parenteral (e.g., subcutaneous, intravenous or intramuscular) formulation. In other embodiments, the carrier is a nonaqueous-based carrier. In certain embodiments, the nonaqueous-based carrier is a hydrofluoroalkane (HFA) or HFA-like solvent that may comprise sub-micron anhydrous α-lactose or/and other excipients, such as in a formulation for administration by oral inhalation or nasal inhalation or insufflation.

In some embodiments, a peptide product is administered parenterally (e.g., subcutaneously, intravenously or intramuscularly) by injection. Parenteral administration bypasses the strongly acidic environment of the stomach, gastrointestinal (GI) absorption and first-pass metabolism. Excipients and carriers that can be used to prepare parenteral formulations include without limitation solvents (e.g., aqueous solvents such as water, saline, physiological saline, buffered saline [e.g., PBS], balanced salt solutions [e.g., Ringer's BSS] and aqueous dextrose solutions), isotonic/iso-osmotic agents (e.g., salts [e.g., NaCl, KCl and $CaCl_2$] and sugars [e.g., sucrose]), buffering agents and pH adjusters (e.g., sodium dihydrogen phosphate [monobasic sodium phosphate]/disodium hydrogen phosphate [dibasic sodium phosphate], citric acid/sodium citrate and L-histidine/L-histidine HCl), and emulsifiers (e.g., non-ionic surfactants such as polysorbates [e.g., polysorbate 20 and 80] and poloxamers [e.g., poloxamer 188]). Peptide formulations and delivery systems are discussed in, e.g., A. J. Banga, Therapeutic Peptides and Proteins: Formulation, Processing, and Delivery Systems, 3rd Ed., CRC Press (Boca Raton, Fla.) (2015).

The excipients can optionally include one or more substances that increase peptide stability, increase peptide solubility, inhibit peptide aggregation or reduce solution viscosity, or any combination or all thereof. Such substances include without limitation hydrophilic amino acids (e.g., arginine and histidine), polyols (e.g., myo-inositol, mannitol and sorbitol), saccharides {e.g., glucose (including D-glucose [dextrose]), lactose, sucrose and trehalose}, osmolytes (e.g., trehalose, taurine, amino acids [e.g., glycine, sarcosine, alanine, proline, serine, β-alanine and γ-aminobutyric acid], and betaines [e.g., trimethylglycine and trimethylamine N-oxide]), and non-ionic surfactants {e.g., alkyl polyglycosides, ProTek® alkylsaccharides (e.g., a monosaccharide [e.g., glucose] or a disaccharide [e.g., maltose or sucrose] coupled to a long-chain fatty acid or a corresponding long-chain alcohol), and polypropylene glycol/polyethylene glycol block co-polymers (e.g., poloxamers [e.g., Pluronic™ F-68], and Genapol® PF-10 and variants thereof)}. Because such substances increase peptide solubility, they can be used to increase peptide concentration in a formulation. Higher peptide concentration in a formulation is particularly advantageous for subcutaneous administration, which has a limited volume of bolus administration (e.g., ≤about 1.5 mL). In addition, such substances can be used to stabilize peptides during the preparation, storage and reconstitution of lyophilized peptides.

Examples of excipients of aqueous formulations, whether pre-made with a peptide therapeutic or prepared after reconstituting a peptide therapeutic in lyophilized or powder form, for parenteral (e.g., subcutaneous or intravenous) administration include without limitation those shown in Table 5. Any formulation in Table 5 for which sodium chloride (NaCl) is not explicitly listed can optionally contain NaCl. An exemplary parenteral formulation comprises a peptide product, mannitol, methionine, sodium thioglycolate, polysorbate 20, a pH adjuster (e.g., NaOH or/and HCl) and de-ionized water.

TABLE 5

Exemplary excipients of parenteral (e.g., intravenous and subcutaneous) formulations NaCl, sodium acetate and water
NaCl, acetic acid, sodium acetate and water
NaCl, citric acid, sodium citrate and water
Mannitol, histidine, glycine and water
NaCl, sucrose, mannitol, glycine, potassium dihydrogen phosphate, disodium hydrogen phosphate and water
NaCl, sodium phosphate or sodium dihydrogen phosphate/disodium hydrogen phosphate, polysorbate 80 and water
NaCl, sodium citrate, polysorbate 80 and water
NaCl, citric acid, sodium citrate, polysorbate 80 and water
NaCl, glycine, citric acid, NaOH, polysorbate 80 and water
NaCl, KCl, potassium dihydrogen phosphate, disodium hydrogen phosphate, polysorbate 80, disodium edetate and water
Sucrose, lactic acid, polysorbate and water
NaCl, sucrose, sodium dihydrogen phosphate, disodium hydrogen phosphate, polysorbate 20 or 80, and water
NaCl, sucrose, citric acid, sodium citrate, polysorbate 80 and water
NaCl, sucrose, glycine, citric acid, sodium citrate, polysorbate 80 and water
NaCl, trehalose, sodium phosphate, polysorbate 20 and water
NaCl, trehalose, citric acid, sodium citrate, polysorbate 80 and water
NaCl, mannitol, sodium dihydrogen phosphate/di sodium hydrogen phosphate or/and citric acid/sodium citrate, polysorbate 80 and water, and optionally NaOH to adjust pH
NaCl, mannitol, sodium citrate, polysorbate 80, pentetic acid and water, and optionally HCl or/and NaOH to adjust pH
NaCl, mannitol, Tris HCl, polysorbate 80, pentetic acid and water
Mannitol or sorbitol, acetic acid, NaOH, polysorbate 20 and water
NaCl, sucrose, L-histidine, polysorbate 80 and water, and optionally HCl or/and NaOH to adjust pH
NaCl, sucrose, L-histidine, acetic acid, polysorbate 20 and water
Sucrose, L-histidine, L-histidine HCl, polysorbate 20 or 80 and water
Trehalose, L-histidine, L-histidine HCl, polysorbate 20 and water
NaCl, trehalose, L-histidine, L-histidine HCl, poloxamer 188 and water
Trehalose, L-histidine, L-histidine HCl, polysorbate 20 and water, and optionally a bacteriostat (e.g., benzyl alcohol)
Trehalose, L-histidine, L-histidine HCl, L-methionine, polysorbate 80 and water
Sorbitol, L-histidine, L-histidine HCl, polysorbate 80 and water
NaCl, glycine, L-histidine, L-histidine HCl, polysorbate 80 and water
NaCl, sucrose, L-arginine HCl, L-histidine, L-histidine HCl, polysorbate 80 and water
Sucrose, sodium acetate, optionally acetic acid, L-arginine HCl, L-histidine, polysorbate 80 and water
L-Arginine, L-arginine HCl, L-histidine, L-histidine HCl, L-methionine, polysorbate 80 and water
Proline, glutamate, polysorbate 20 and water
Propylene glycol, phenol, disodium hydrogen phosphate and water, and optionally HCl or/and NaOH to adjust pH
NaCl, sucrose or maltose, sodium dihydrogen phosphate and water
Sucrose, sodium dihydrogen phosphate, disodium hydrogen phosphate, poloxamer 188 and water
NaCl, sucrose, sodium phosphate, L-arginine HCl and water
Sucrose, glycine, L-arginine HCl, L-histidine, L-histidine HCl, PEG 3350 and water
Mannitol, trehalose, sodium phosphate, polysorbate 80 and water TABLE 5-continued Exemplary excipients of parenteral (e.g., intravenous and subcutaneous) formulations Mannitol, citric acid, trisodium citrate, polysorbate 80 and water
NaCl, CaCl$_2$, sucrose, L-histidine, polysorbate 20 and water
Sucrose, mannitol, L-histidine, HCl, polysorbate 20 and water
NaCl, sucrose, mannitol, L-histidine, HCl, NaOH, polysorbate 20 and water For parenteral (e.g., subcutaneous, intravenous or intramuscular) administration, a sterile solution or suspension of a peptide product in an aqueous solvent containing one or more excipients can be prepared beforehand and can be provided in, e.g., a pre-filled syringe of a single-use pen or a pen with a dose counter. Alternatively, a peptide product can be dissolved or suspended in an aqueous solvent that can optionally contain one or more excipients prior to lyophilization (freeze-drying). Shortly prior to parenteral administration, the lyophilized peptide product stored in a suitable container (e.g., a vial) can be reconstituted with, e.g., sterile water that can optionally contain one or more excipients.

In other embodiments, a peptide product is administered intranasally. The nasal mucosa provides a big surface area, a porous endothelium, a highly vascular subepithelial layer and a high absorption rate, and hence allows for high bioavailability. An intranasal formulation can comprise a peptide product along with excipients, such as a solubility enhancer (e.g., propylene glycol), a humectant (e.g., mannitol or sorbitol), a buffer and water, and optionally a preservative (e.g., benzalkonium chloride), a mucoadhesive agent (e.g., hydroxyethylcellulose) or/and a penetration enhancer. An intranasal solution or suspension formulation can be administered to the nasal cavity by any suitable means, including but not limited to a dropper, a pipette, or spray using, e.g., a metering atomizing spray pump. Table 6 shows exemplary excipients of nasal-spray formulations.

alveolar region for absorption, high permeability of the lungs (thin air-blood barrier), and profuse vasculature of the airways; and 4) reduced extracellular enzyme levels compared to the GI tract due to the large alveolar surface area. An advantage of oral inhalation over nasal inhalation includes deeper penetration/deposition of the drug into the lungs, although nasal inhalation can deliver the drug into systemic circulation transmucosally in the nasal cavity as well as in the lungs.

Oral or nasal inhalation can be achieved by means of, e.g., a metered-dose inhaler (MDI), a nebulizer or a dry powder inhaler (DPI). For example, a peptide product can be formulated for aerosol administration to the respiratory tract by oral or nasal inhalation. The drug is delivered in a small particle size (e.g., between about 0.5 micron and about 5 microns), which can be obtained by micronization, to improve, e.g., drug deposition in the lungs and drug suspension stability. The drug can be provided in a pressurized pack with a suitable propellant, such as a hydrofluoroalkane (HFA, e.g., 1,1,1,2-tetrafluoroethane [IFA-134a]), a chlorofluorocarbon (CFC, e.g., dichlorodifluoromethane, trichlorofluoromethane or dichlorotetrafluoroethane), or a suitable gas (e.g., oxygen, compressed air or carbon dioxide). The drug in the aerosol formulation is dissolved, or more often suspended, in the propellant for delivery to the lungs. The aerosol can contain excipients such as a surfactant (which enhances penetration into the lungs by reducing the high surface tension forces at the air-water interface within the

TABLE 6

Exemplary excipients and carriers of nasal and pulmonary formulations

| Dosage Form | Ingredients in Addition to a Peptide Product |
|---|---|
| nasal spray | microcrystalline cellulose, sodium carboxymethylcellulose, dextrose, water, and optionally a pH adjuster (e.g., HCl) |
| nasal spray | microcrystalline cellulose, carboxymethyl cellulose sodium, dextrose, polysorbate 80, disodium edetate, potassium sorbate, a pH adjuster (e.g., HCl), water, and optionally an alcohol (e.g., ethanol) |
| nasal spray | microcrystalline cellulose, carboxymethyl cellulose sodium, dextrose, polysorbate 80, benzalkonium chloride, phenylethyl alcohol, water, and optionally an alcohol (e.g., ethanol) |
| nasal spray | hypromellose, benzalkonium chloride, NaCl, EDTA, citric acid, sodium phosphate dibasic, water, and optionally an alcohol (e.g., ethanol) |
| inhalation (DPI) | mannitol, glycine, sodium citrate and NaOH |
| inhalation (DPI) | lactose, starch, a starch derivative (e.g., hydroxypropylmethyl cellulose) or polyvinylpyrrolidine, and optionally magnesium stearate or/and leucine |
| inhalation (MDI) | a propellant (e.g., 1,1,1,2-tetrafluoroethane), a surfactant (e.g., lecithin or oleic acid), and a co-solvent (e.g., ethanol) |
| inhalation (nebulizer) | polysorbate 80, edetate disodium, sodium chloride, pH buffering agents (e.g., citric acid/sodium citrate), and water |

In further embodiments, a peptide product is administered pulmonarily, such as by oral inhalation or nasal inhalation. A pulmonarily administered drug can treat a lung disorder or/and a systemic disorder, as the lungs serve as a portal to the systemic circulation. Advantages of pulmonary drug delivery include, for example: 1) avoidance of first-pass metabolism; 2) fast drug action; 3) large surface area of the alveoli, may also emulsify, solubilize or/and stabilize the drug, and can be, e.g., a phospholipid such as lecithin) or/and a stabilizer, although the surfactant moiety of the peptide product can perform functions of a surfactant. For example, an MDI formulation can comprise a peptide product, a propellant (e.g., an HFA such as 1,1,1,2-tetrafluoroethane) and a co-solvent (e.g., an alcohol such as ethanol), and optionally a surfactant (e.g., a fatty acid such as oleic acid). The MDI formulation can optionally contain a dissolved gas (e.g., $CO_2$). After device actuation, the bursting of $CO_2$ bubbles within the emitted aerosol droplets breaks up the droplets into smaller droplets, thereby increasing the respirable fraction of drug. As another example, a nebulizer formulation can comprise a peptide product, a chelator or preservative (e.g., edetate disodium), an isotonicity agent (e.g., NaCl), pH buffering agents (e.g., citric acid/sodium citrate) and water, and optionally a surfactant (e.g., a Tween® such as polysorbate 80). The drug can be delivered by means of, e.g., a nebulizer or an MDI with or without a spacer, and the drug dose delivered can be controlled by a metering chamber (nebulizer) or a metering valve (MDI). Table 6 shows exemplary MDI, nebulizer and DPI formulations.

Metered-dose inhalers (also called pressurized metered-dose inhalers [pMDI]) are the most widely used inhalation devices. A metering valve delivers a precise amount of aerosol (e.g., about 20-100 µL) each time the device is actuated. MDIs typically generate aerosol faster than the user can inhale, which can result in deposition of much of the aerosol in the mouth and the throat. The problem of poor coordination between device actuation and inhalation can be addressed by using, e.g., a breath-actuated MD1 or a coordination device. A breath-actuated MDI (e.g, Easibreathe®) is activated when the device senses the user's inspiration and discharges a drug dose in response. The inhalation flow rate is coordinated through the actuator and the user has time to actuate the device reliably during inhalation. In a coordination device, a spacer (or valved holding chamber), which is a tube attached to the mouthpiece end of the inhaler, serves as a reservoir or chamber holding the drug that is sprayed by the inhaler and reduces the speed at which the aerosol enters the mouth, thereby allowing for the evaporation of the propellant from larger droplets. The spacer simplifies use of the inhaler and increases the amount of drug deposited in the lungs instead of in the upper airways. The spacer can be made of an anti-static polymer to mininize electrostatic adherence of the enitted drug particles to the inner walls of the spacer.

Nebulizers generate aerosol droplets of about 1-5 microns. They do not require user coordination between device actuation and inhalation, which can significantly affect the amount of drug deposited in the lungs. Compared to MDIs and DPIs, nebulizers can deliver larger doses of drug, albeit over a longer administration time. Examples of nebulizers include without limitation human-powered nebulizers, jet nebulizers (e.g., AeroEclipse® II BAN [breath-actuated], CompAIRm NE-C801 [virtual valve], PARI LC® Plus [breath-enhanced] and SideStream Plus [breath-enhanced]), ultrasonic wave nebulizers, and vibrating mesh nebulizers (e.g., Akita2@ Apixneb, I-neb AAD System with metering chambers, MicroAir® NE-U22, Omron U22 and PARI eFlow® rapid). As an example, a pulsed ultrasonic nebulizer can aerosolize a fixed amount of the drug per pulse, and can comprise an opto-acoustical trigger that allows the user to synchronize each breath to each pulse.

For oral or nasal inhalation using a dry powder inhaler (DPI), a peptide product can be provided in the form of a dry micronized powder, where the drug particles are of a certain small size (e.g., between about 0.5 micron and about 5 microns) to improve, e.g., aerodynamic properties of the dispersed powder and drug deposition in the lungs. Particles between about 0.5 micron and about 5 microns deposit by sedimentation in the terminal bronchioles and the alveolar regions. By contrast, the majority of larger particles (>5 microns) do not follow the stream of air into the many bifurcations of the airways, but rather deposit by impaction in the upper airways, including the oropharyngeal region of the throat. A DPI formulation can contain the drug particles alone or be blended with a powder of a suitable larger base/carrier, such as lactose, starch, a starch derivative (e.g., hydroxypropylmethyl cellulose) or polyvinylpyrrolidine. The carrier particles enhance flow, reduce aggregation, improve dose uniformity and aid in dispersion of the drug particles. A DPI formulation can optionally contain an excipient such as magnesium stearate or/and leucine that improves the performance of the formulation by interfering with inter-particle bonding (by anti-adherent action). The powder formulation can be provided in unit dose form, such as a capsule (e.g., a gelatin capsule) or a cartridge in a blister pack, which can be manually loaded or pre-loaded in an inhaler. The drug particles can be drawn into the lungs by placing the mouthpiece or nosepiece of the inhaler into the mouth or nose, taking a sharp, deep inhalation to create turbulent airflow, and holding the breath for a period of time (e.g., about 5-10 seconds) to allow the drug particles to settle down in the bronchioles and the alveolar regions. When the user actuates the DPI and inhales, airflow through the device creates shear and turbulence, inspired air is introduced into the powder bed, and the static powder blend is fluidized and enters the user's airways. There, the drug particles separate from the carrier particles due to turbulence and are carried deep into the lungs, while the larger carrier particles impact on the oropharyngeal surfaces and are cleared. Thus, the user's inspiratory airflow achieves powder de-agglomeration and aeroionisation, and determines drug deposition in the lungs. (While a passive DPI requires rapid inspiratory airflow to de-agglomerate drug particles, rapid inspiration is not recommended with an MDI or nebulizer, since it creates turbulent airflow and fast velocity which increase drug deposition by impaction in the upper airways.) Compared to an MDI, a DPI (including a breath-activated DPI) may be able to deliver larger doses of drug, and larger-size drugs (e.g., macromolecules), to the lungs.

Lactose (e.g., alpha-lactose monohydrate) is the most commonly used carrier in DPI formulations. Examples of grades/types of lactose monohydrate for DPI formulations include without limitation DCL 11, Flowlac® 100, Inhalac® 230, Lactohale® 300, Lactopress® SD 250 (spray-dried lactose), Respitose® SV03 and Sorbolac® 400. A DPI formulation can contain a single lactose grade or a combination of different lactose grades. For example, a fine lactose grade like Lactohale® 300 or Sorbolac® 400 may not be a suitable DPI carrier and may need to be blended with a coarse lactose grade like DCL 11, Flowlac® 100, Inhalac® 230 or Respitose® SVO03 (e.g., about a 1:9 ratio of fine lactose to coarse lactose) to improve flow. Tables 7 and 8 show non-limiting examples of grades/types of lactose that can be used in DPI formulations. The distribution of the carrier particle sizes affects the fine particle fraction/dose (FPF or FPD) of the drug, with a high FPF being desired for drug delivery to the lungs. FPF/FPD is the respirable fraction/dose mass out of the DPI device with an aerodynamic particle size ≤5 microns in the inspiration air. High FPF, and hence good DPI performance, can be obtained from, e.g., DPI formulations having an approximately 1:9 ratio of fine lactose (e.g., Lactohale® 300) to coarse lactose (e.g., Respitose® SV003) and about 20% w/w overages to avoid deposition of the drug in the capsule shell or the DPI device and to deliver essentially all of the drug to the airways.

TABLE 7

| | | Range of Particle Sizes (μm) | | |
|---|---|---|---|---|
| Product | Type | 10% | 50% | 90% |
| Lactohale ® | LH200 | <9 | <69 | <141 |
| InhaLac ® | 230 | <35 | <93 | <138 |
| Respitose ® | ML001 | <4 | <43 | <146 |
| | ML003 | <4 | <35 | <106 |
| | SV003 | <30 | <59 | <90 |
| | SV004 | <32 | <61 | <93 |

TABLE 8

| | | Range of Particle Sizes | | | |
|---|---|---|---|---|---|
| Product | Type | <45 μm | <100 μm | <150 μm | <250 μm |
| Respitose ® | ML003 | 65% | 98% | 100% | NA |
| Respitose ® | ML002 | 65% | 98% | NA | 100% |

Other carriers for DPI formulations include without limitation glucose, mannitol (e.g., crystallized mannitol [Pearlitol 110 C] and spray-dried mannitol [Pearlitol 100 SD]), maltitol (e.g., crystallized maltitol [Maltisorb P90]), sorbitol and xylitol.

Most DPIs are breath-activated ("passive"), relying on the user's inhalation for aerosol generation. Examples of passive DPIs include without limitation Airmax®, Novolizer® and Otsuka DPI (compact cake). The air classifier technology (ACT) is an efficient passive powder dispersion mechanism employed in DPIs. In ACT, multiple supply channels generate a tangential airflow that results in a cyclone within the device during inhalation. There are also power-assisted ("active") DPIs (based on, e.g., pneumatics, impact force or vibration) that use energy to aid, e.g., particle de-agglomeration. For example, the active mechanism of Exubera® inhalers utilizes mechanical energy stored in springs or compressed-air chambers. Examples of active DPIs include without limitation Actispire® (single-unit dose), Aspirair® (multi-dose), Exubera® (single-unit dose), MicroDose® (multi-unit dose and electronically activated), Omnihaler® (single-unit dose), Pfeiffer DPI (single-unit dose), and Spiros® (multi-unit dose).

A peptide product can also be administered by other routes, such as orally. An oral formulation can contain a peptide product and conventional excipients known in the art, and optionally an absorption enhancer such as sodium N-[8-(2-hydroxybenzoyl)aminocaprylate](SNAC). SNAC protects against enzymatic degradation via local buffering action and enhances GI absorption. An oral dosage form (e.g., a tablet, capsule or pill) can optionally have an enteric coating to protect its content from the strong acids and proteolytic enzymes of the stomach.

In some embodiments, a peptide product is delivered from a sustained-release composition. As used herein, the term "sustained-release composition" encompasses sustained-release, prolonged-release, extended-release, delayed-release, slow-release and controlled-release compositions, systems and devices. In some embodiments, a sustained-release composition delivers a peptide product over a period of at least about 1 week, 2 weeks, 3 weeks, 1 month, 2 months, 3 months or longer.

In some embodiments, a sustained-release composition is formulated as nanoparticles or microparticles composed of a biodegradable polymer and incorporating a peptide product. In certain embodiments, the biodegradable polymer comprises lactic acid or/and glycolic acid [e.g., an L-lactic acid-based copolymer, such as poly(L-lactide-co-glycolide) or poly(L-lactic acid-co-D,L-2-hydroxyoctanoic acid)].

In further embodiments, a sustained-release composition is in the form of a depot that is generated when a mixture of a peptide product and a polymer is injected into a subject intramuscularly or subcutaneously. In certain embodiments, the polymer is or comprises PEG, polylactic acid (PLA) or polyglycolic acid (PGA), or a copolymer thereof (e.g., PLGA or PLA-PEG).

A pharmaceutical composition can be presented in unit dosage form as a single dose wherein all active and inactive ingredients are combined in a suitable system, and components do not need to be mixed to form the composition to be administered. A unit dosage form generally contains a therapeutically effective dose of the drug, but can contain an appropriate fraction thereof so that taking multiple unit dosage forms achieves the therapeutically effective dose. Examples of a unit dosage form include a tablet, capsule or pill for oral uptake; a solution in a pre-filled syringe of a single-use pen or a pen with a dose counter for parenteral (e.g., intravenous, subcutaneous or intramuscular) injection; and a capsule, cartridge or blister pre-loaded in or manually loaded into an inhaler.

Alternatively, a pharmaceutical composition can be presented as a kit in which the active ingredient, excipients and carriers (e.g., solvents) are provided in two or more separate containers (e.g., ampules, vials, tubes, bottles or syringes) and need to be combined to form the composition to be administered. The kit can contain instructions for storing, preparing and administering the composition (e.g., a solution to be injected parenterally).

A kit can contain all active and inactive ingredients in unit dosage form or the active ingredient and inactive ingredients in two or more separate containers, and can contain instructions for administering or using the pharmaceutical composition to treat a medical condition disclosed herein. A kit can further contain a device for delivering the composition, such as an injection pen or an inhaler.

In some embodiments, a kit contains a peptide product or a pharmaceutically acceptable salt thereof, or a pharmaceutical composition comprising the same, and instructions for administering or using the peptide product or the composition to treat a medical condition disclosed herein, such as insulin resistance, diabetes, obesity, metabolic syndrome or a cardiovascular disease, or a condition associated therewith (e.g., NASH or PCOS). In certain embodiments, the kit further contains a device for delivering the peptide product or the composition, such as an injection pen or an inhaler.

Therapeutic Uses of Peptide Products

The disclosure further provides uses of the peptide products described herein to treat, e.g., insulin resistance, diabetes, obesity, metabolic syndrome and cardiovascular diseases, and conditions associated therewith, such as NASH and PCOS.

In some embodiments, the peptide products are used to treat hyperglycemia, insulin resistance, hyperinsulinemia, prediabetes, diabetes (including types 1 and 2, gestational and juvenile diabetes), diabetic complications, diabetic neuropathy, diabetic nephropathy, diabetic retinopathy, hyperlipidemia, hypercholesterolemia, hypertriglyceridemia, elevated blood levels of free fatty acids, obesity, metabolic syndrome, syndrome X, cardiovascular diseases (including coronary artery disease), atherosclerosis, acute cardiovascular syndrome, ischemia (including myocardial ischemia and cerebral ischemia/stroke), ischemia-reperfusion injury (including myocardial and cerebral IRI), infarction (including myocardial and cerebral infarction), angina, heart failure (e.g., congestive heart failure), peripheral vascular disease, thrombosis (e.g., deep vein thrombosis), embolism (e.g., pulmonary embolism), systemic inflammation (e.g., one characterized by elevated C-reactive protein blood level), and hypertension. The peptide products can achieve their therapeutic effects through various mechanisms, including stimulation of blood glucose-dependent insulin secretion, increase in insulin sensitivity, stimulation of fat burning and reduction of body weight. The peptide products can also promote, e.g., pancreatic beta-cell protection, cardioprotection and wound healing.

The peptide products described herein can be used to treat other conditions associated with insulin resistance or/and obesity. Other conditions associated with insulin resistance or/and obesity include without limitation arthritis (e.g., osteoarthritis), low back pain, breathing disorders (e.g., asthma, obesity hypoventilation syndrome [Pickwickian syndrome] and obstructive sleep apnea), dermatological disorders (e.g., diabetic ulcers, acanthosis nigricans, cellulitis, hirsutism, intertrigo and lymphedema), gastroenterological disorders (e.g., cholelithiasis [gallstone], gastroesophageal reflux disease [GERD] and gastroparesis), gout, hypercortisolism (e.g., Cushing's syndrome), kidney disorders (e.g., chronic kidney disease), liver disorders (e.g., fatty liver disease [FLD] including alcoholic and non-alcoholic FLD), neurological disorders (e.g., carpal tunnel syndrome, dementias [e.g., Alzheimer's disease and vascular dementia], meralgia paresthetica, migraines and multiple sclerosis), urological disorders (e.g., erectile dysfunction, hypogonadism and urinary incontinence), polycystic ovary syndrome, infertility, menstrual disorders, mood disorders (e.g., depression), and cancers (e.g., cancers of the endometrium, esophagus, colorectum, gallbladder, kidney, liver [e.g., hepatocellular carcinoma], pancreas and skin [e.g., melanoma], and leukemia).

In certain embodiments, a peptide product described herein is used to treat polycystic ovary syndrome (PCOS). In other embodiments, a peptide product is used to treat chronic kidney disease (CKD), also known as chronic kidney/renal failure (CKF/CRF). The most common causes of CKD are diabetes and long-term, uncontrolled hypertension.

In further embodiments, a peptide product described herein is used to treat fatty liver disease (FLD). In some embodiments, the FLD is non-alcoholic fatty liver disease (NAFLD). In certain embodiments, the NAFLD is non-alcoholic steatohepatitis (NASH). FLD, also known as hepatic steatosis, is characterized by excessive fat accumulation in the liver. FLD includes alcoholic fatty liver disease (AFLD) and NAFLD. Chronic alcoholism causes fatty liver due to production of toxic metabolites such as aldehydes during metabolism of alcohol in the liver. NAFLD is described below. FLD is associated with diabetes, obesity and metabolic syndrome. Fatty liver can develop into cirrhosis or a liver cancer (e.g., hepatocellular carcinoma [HCC]). Less than about 10% of people with cirrhotic AFLD develop HCC, but up to about 45% of people with NASH without cirrhosis may develop HCC. HCC is the most common type of primary liver cancer in adults and occurs in the setting of chronic liver inflammation.

NAFLD is characterized by fatty liver that occurs when fat, in particular free fatty acids and triglycerides, accumulates in liver cells (hepatic steatosis) due to causes other than excessive alcohol consumption, such as nutrient overload, high caloric intake and metabolic dysfunction (e.g., dyslipidemia and impaired glucose control). A liver can remain fatty without disturbing liver function, but a fatty liver can progress to become NASH, a condition in which steatosis is accompanied by inflammation, hepatocyte ballooning and cell injury with or without fibrosis of the liver. Fibrosis is the strongest predictor of mortality from NASH. NAFLD can be characterized by steatosis alone; steatosis with lobular or portal inflammation but without ballooning; steatosis with ballooning but without inflammation; or steatosis with inflammation and ballooning.

NASH is the most extreme form of NAFLD. NASH is a progressive disease, with about 20% of patients developing cirrhosis of the liver and about 10% dying from a liver disease, such as cirrhosis or a liver cancer (e.g., HCC). NAFLD is the most common liver disorder in developed countries, and NASH is projected to supplant hepatitis C as the major cause of liver transplant in the U.S. by 2020. About 12-25% of people in the U.S. have NAFLD, with NASH affecting about 2-5% of people in the U.S.

NAFLD, including NASH, is associated with insulin resistance, obesity and metabolic syndrome. For instance, insulin resistance contributes to progression of fatty liver to hepatic inflammation and fibrosis and thus NASH. Furthermore, obesity drives and exacerbates NASH, and weight loss can alleviate NASH. Therefore, the peptide products described herein, including GLP-1 receptor (GLP1R) agonists, glucagon receptor (GCGR) agonists and dual GLP1R/GCGR agonists, can be used to treat NAFLD, including NASH.

In some embodiments, the peptide products used to treat a condition associated with insulin resistance or/and obesity disclosed herein, such as NAFLD (e.g., NASH) or PCOS, are selected from the peptide products of SEQ. ID. NOs. 601, 602, 603, 604, 630, 631, 632, 633, 634, 805, 819, 820, 821, 1114, 1115, 1116, 1117, 1118, 1119, 1120, 1121, 1122, 1123, 1124, 1125, and pharmaceutically acceptable salts thereof.

A peptide product can be administered by any suitable route for treatment of a condition disclosed herein. Potential routes of administration of a peptide product include without limitation oral, parenteral (including intradermal, subcutaneous, intramuscular, intravascular, intravenous, intra-arterial, intraperitoneal, intracavitary and topical), and topical (including transdermal, transmucosal, intranasal [e.g., by nasal spray or drop], ocular [e.g., by eye drop], pulmonary [e.g., by oral or nasal inhalation], buccal, sublingual, rectal [e.g., by suppository], and vaginal [e.g., by suppository]). In some embodiments, a peptide product is administered parenterally, such as subcutaneously, intravenously or intramuscularly. In other embodiments, a peptide product is administered by oral inhalation or nasal inhalation or insufflation.

The therapeutically effective amount and the frequency of administration of, and the length of treatment with, a peptide product to treat a condition disclosed herein may depend on various factors, including the nature and severity of the condition, the potency of the compound, the route of administration, the age, body weight, general health, gender and diet of the subject, and the response of the subject to the treatment, and can be determined by the treating physician.

In some embodiments, a peptide product is administered parenterally (e.g., subcutaneously [sc], intravenously [iv] or intramuscularly [im]) in a dose from about 0.1 mg to about 1, 5 or 10 mg, or about 0.1-1 mg or 1-10 mg, over a period of about one week for treatment of a condition disclosed herein (e.g., one associated with insulin resistance or/and obesity, such as NASH or PCOS). In further embodiments, a peptide product is administered parenterally (e.g., sc, iv or im) in a dose of about 0.1-0.5 mg, 0.5-1 mg, 1-5 mg or 5-10 mg over a period of about one week. In certain embodiments, a peptide product is administered parenterally (e.g., sc, iv or im) in a dose of about 0.1-1 mg, or about 0.1-0.5 mg or 0.5-1 mg, over a period of about one week.

A peptide product can be administered in any suitable frequency for treatment of a condition disclosed herein (e.g., one associated with insulin resistance or/and obesity, such as NASH or PCOS). In some embodiments, a peptide product is administered, e.g., sc or iv once a day, once every two days, once every three days, twice a week, once a week or once every two weeks. In certain embodiments, a peptide product is administered, e.g., sc or iv once a week.

A peptide product can be administered at any time of day convenient to the patient. A peptide product can be taken substantially with food (e.g., with a meal or within about 1 hour or 30 minutes before or after a meal) or substantially without food (e.g., at least about 1 or 2 hours before or after a meal).

The length of treatment of a medical condition with a peptide product can be based on, e.g., the nature and severity of the condition and the response of the subject to the treatment, and can be determined by the treating physician. In some embodiments, a peptide product is administered chronically to treat a condition disclosed herein, such as at least about 2 months, 3 months, 6 months, 1 year, 1.5 years, 2 years, 3 years, 5 years, 10 years or longer. A peptide product can also be taken pro re nata (as needed) until clinical manifestations of the condition disappear or clinical targets are achieved, such as blood glucose level, blood pressure, blood levels of lipids, body weight or body mass index, waist-to-hip ratio or percent body fat, or any combination thereof. If clinical manifestations of the condition re-appear or the clinical targets are not maintained, administration of the peptide product can resume.

The disclosure provides a method of treating a medical condition described herein, comprising administering to a subject in need of treatment a therapeutically effective amount of a peptide product described herein or a pharmaceutically acceptable salt thereof, or a pharmaceutical composition comprising the same. The disclosure further provides a peptide product described herein or a pharmaceutically acceptable salt thereof, or a composition comprising the same, for use as a medicament. In addition, the disclosure provides for the use of a peptide product described herein or a pharmaceutically acceptable salt thereof in the preparation of a medicament. The medicament containing the peptide product can be used to treat any medical condition described herein. The peptide product can optionally be used in combination with one or more additional therapeutic agents.

Combination Therapies

A peptide product described herein can optionally be used in combination with one or more additional therapeutic agents to treat any disorder disclosed herein, such as insulin resistance, diabetes, obesity, metabolic syndrome or a cardiovascular disease, or any condition associated therewith, such as NASH or PCOS. In some embodiments, the one or more additional therapeutic agents are selected from antidiabetic agents, anti-obesity agents (including lipid-lowering agents and pro-satiety agents), anti-atherosclerotic agents, anti-inflammatory agents, antioxidants, antifibrotic agents, anti-hypertensive agents, and combinations thereof.

Antidiabetic agents include without limitation:

AMP-activated protein kinase (AMPK) agonists, including biguanides (e.g., buformin and metformin);

peroxisome proliferator-activated receptor gamma (PPAR-γ) agonists, including thiazolidinediones (e.g., balaglitazone, ciglitazone, darglitazone, englitazone, lobeglitazone, netoglitazone, pioglitazone, rivoglitazone, rosiglitazone and troglitazone) and saroglitazar (dual PPAR-α/γ agonist);

glucagon-like peptide-1 (GLP-1) receptor agonists, including exendin-4, albiglutide, dulaglutide, exenatide, liraglutide, lixisenatide, semaglutide, taspoglutide, CNTO736, CNT03649, HMI11260C (LAPS-Exendin), NN9926 (OG9S7GT), TT401 and ZYOG1;

dipeptidyl peptidase 4 (DPP-4) inhibitors, including alogliptin, anagliptin, dutogliptin, evogliptin, gemigliptin, gosogliptin, linagliptin, omarigliptin, saxagliptin, septagliptin, sitagliptin, teneligliptin, trelagliptin and vildagliptin;

sodium-glucose transport protein 2 (SGLT2) inhibitors, including canagliflozin (also inhibits SGLT1), dapagliflozin, empagliflozin, ertugliflozin, ipragliflozin, luseogliflozin, remogliflozin etabonate, sotagliflozin (also inhibits SGLT1) and tofogliflozin; blockers of ATP-dependent $K^+$ ($K_{ATP}$) channels on pancreatic beta cells, including meglitinides (e.g., mitiglinide, nateglinide and repaglinide) and sulfonylureas {including first generation (e.g., acetohexamide, carbutamide, chlorpropamide, glycyclamide [tolhexamide], metabexamide, tolazarnide and tolbutamide) and second generation (e.g., glibenclamide [glyburide], glibornuride, gliclazide, glimepiride, glipizide, gliquidone, glisoxepide and glyclopyramide)};

insulin and analogs thereof, including fast-acting insulin (e.g., insulin aspart, insulin glulisine and insulin lispro), intermediate-acting insulin (e.g., NPH insulin), and long-acting insulin (e.g., insulin degludec, insulin detemir and insulin glargine); and analogs, derivatives and salts thereof.

In certain embodiments, the antidiabetic agent is or includes a biguanide (e.g., metformin), a thiazolidinedione (e.g., pioglitazone or rosiglitazone) or a SGLT2 inhibitor (e.g., empagliflozin or tofogliflozin), or any combination thereof.

Anti-obesity agents include, but are not limited to:

appetite suppressants (anorectics), including amphetamine, dexamphetamine, amfeprarnone, clobenzorex, mazindol, phentermine (with or without topiramate) and lorcaserin;

pro-satiety agents, including ciliary neurotrophic factor (e.g., axokine) and longer-acting analogs of amylin, calcitonin, cholecystokinin (CCK), GLP-1, leptin, oxyntomodulin, pancreatic polypeptide (PP), peptide YY (PYY) and neuropeptide Y (NPY);

lipase inhibitors, including caulerpenyne, cetilistat, ebelactone A and B, esterastin, lipstatin, orlistat, percyquinin, panclicin A-E, valilactone and vibralactone;

antihyperlipidemic agents; and analogs, derivatives and salts thereof.

Antihyperlipidemic agents include without limitation:

HMG-CoA reductase inhibitors, including statins {e.g., atorvastatin, cerivastatin, fluvastatin, mevastatin, monacolins (e.g., monacolin K [lovastatin]), pitavastatin, pravastatin, rosuvastatin and simvastatin} and flavanones (e.g., naringenin);

squalene synthase inhibitors, including lapaquistat, zaragozic acid and RPR-107393;

acetyl-CoA carboxylase (ACC) inhibitors, including anthocyanins, avenaciolides, chloroacetylated biotin, cyclodim, diclofop, haloxyfop, soraphens (e.g., soraphen $A_{1\alpha}$), 5-(tetradecyloxy)-2-furancarboxylic acid (TOFA), CP-640186, GS-0976, NDI-010976; 7-(4-propyloxy-phenylethynyl)-3,3-dimethyl-3,4 dihydro-2H-benzo[b][1,4]dioxepine; N-ethyl-N'-(3-{[4-(3,3-dimethyl-1-oxo-2-oxa-7-azaspiro[4.5]dec-7-yl)piperidin-1-yl]-carbonyl}-1- benzothien-2-yl)urea; 5-(3-acetamidobut-1-ynyl)-2-(4-propyloxyphenoxy)thiazole; and 1-(3-{[4-(3,3-dimethyl-1-oxo-2-oxa-7-azaspiro[4.5]dec-7-yl)piperidin-1-yl]-carbonyl}-5-(pyridin-2-yl)-2-thienyl)-3-ethylurea;

PPAR-α agonists, including fibrates (e.g., bezafibrate, ciprofibrate, clinofibrate, clofibric acid, clofibrate, aluminum clofibrate [alfibrate], clofibride, etofibrate, fenofibric acid, fenofibrate, gemfibrozil, ronifibrate and simfibrate), isoflavones (e.g., daidzein and genistein), and perfluoroalkanoic acids (e.g., perfluorooctanoic acid and perfluorononanoic acid);

PPAR-δ agonists, including elafibranor (dual PPAR-α/δ agonist), GFT505 (dual PPAR-α/δ agonist), GW0742, GW501516 (dual PPAR-β/δ agonist), sodelglitazar (GW677954), MBX-8025, and isoflavones (e.g., daidzein and genistein);

PPAR-γ agonists, including thiazolidinediones (supra), saroglitazar (dual PPAR-α/γ agonist), 4-oxo-2-thioxothiazolines (e.g., rhodanine), berberine, honokiol, perfluorononanoic acid, cyclopentenone prostaglandins (e.g., cyclopentenone 15-deoxy-Δ-prostaglandin $J_2$ [15d-PGJ$_2$]), and isoflavones (e.g., daidzein and genistein);

liver X receptor (LXR) agonists, including endogenous ligands (e.g., oxysterols such as 22(R)-hydroxycholesterol, 24(S)-hydroxycholesterol, 27-hydroxycholesterol and cholestenoic acid) and synthetic agonists (e.g., acetyl-podocarpic dimer, hypocholamide, N,N-dimethyl-3β-hydroxycholenamide [DMHCA], GW3965 and T0901317);

retinoid X receptor (RXR) agonists, including endogenous ligands (e.g., 9-cis-retinoic acid) and synthetic agonists (e.g., bexarotene, AGN 191659, AGN 191701, AGN 192849, BMS649, LG100268, LG100754 and LGD346);

inhibitors of acyl-CoA cholesterol acyltransferase (ACAT, aka sterol O-acyltransferase [SOAT], including ACAT1 [SOAT1] and ACAT2 [SOAT2]), including avasimibe, pactimibe, pellitorine, terpendole C and flavanones (e.g., naringenin);

inhibitors of stearoyl-CoA desaturase-1 (SCD-1, aka stearoyl-CoA delta-9 desaturase) activity or expression, including aramchol, CAY-10566, CVT-11127, SAR-224, SAR-707, XEN-103; 3-(2-hydroxyethoxy)-4-methoxy-N-[5-(3-trifluoromethylbenzyl)thiazol-2-yl]benzamide and 4-ethylamino-3-(2-hydroxyethoxy)-N-[5-(3-trifluoromethylbenzyl)thiazol-2-yl]benzamide; 1'-{6-[5-(pyridin-3-ylmethyl)-1,3,4-oxadiazol-2-yl]pyridazin-3-yl}-5-(trifluoromethyl)-3,4-dihydrospiro[chromene-2,4'-piperidine]; 5-fluoro-1'-{6-[5-(pyridin-3-ylmethyl)-1,3,4-oxadiazol-2-yl]pyridazin-3-yl}-3,4-dihydrospiro[chromene-2,4'-piperidine]; 6-[5-(cyclopropylmethyl)-4,5-dihydro-1'H,3H-spiro[1,5-benzoxazepine-2,4'-piperidin]-1'-yl]-N-(2-hydroxy-2-pyridin-3-ylethyl)pyridazine-3-carboxamide; 6-[4-(2-methylbenzoyl)piperidin-1-yl]pyridazine-3-carboxylic acid (2-hydroxy-2-pyridin-3-ylethyl)amide; 4-(2-chlorophenoxy)-N-[3-(methyl carbamoyl)phenyl]piperidine-1-carboxamide; the cis-9,trans-11 isomer and the trans-10,cis-12 isomer of conjugated linoleic acid, substituted heteroaromatic compounds disclosed in WO 2009/129625 A1, anti-sense polynucleotides and peptide-nucleic acids (PNAs) that target mRNA for SCD-1, and SCD-1-targeting siRNAs;

cholesterylester transfer protein (CETP) inhibitors, including anacetrapib, dalcetrapib, evacetrapib, torcetrapib and AMG 899 (TA-8995);

inhibitors of microsomal triglyceride transfer protein (MTTP) activity or expression, including implitapide, lomitapide, dirlotapide, mitratapide, CP-346086, JTT-130, SLx-4090, anti-sense polynucleotides and PNAs that target mRNA for MTTP, MTTP-targeting microRNAs (e.g., miRNA-30c), and MTTP-targeting siRNAs;

GLP-1 receptor agonists (supra);

fibroblast growth factor 21 (FGF21) and analogs and derivatives thereof, including BMS-986036 (pegylated FGF21);

inhibitors of pro-protein convertase subtilisin/kexin type 9 (PCSK9) activity or expression, including berberine (reduces PCSK9 level), annexin A2 (inhibits PCSK9 activity), anti-PCSK9 antibodies (e.g., alirocumab, bococizumab, evolocumab, LGT-209, LY3015014 and RG7652), peptides that mimic the epidermal growth factor-A (E-A) domain of the LDL receptor which binds to PCSK9, PCSK9-binding adnectins (e.g., BMS-962476), anti-sense polynucleotides and PNAs that target mRNA for PCSK9, and PCSK9-targeting siRNAs (e.g., inclisiran [ALN-PCS] and ALN-PCS02);

apolipoprotein mimetic peptides, including apoA-I mimetics (e.g., 2F, 3F, 3F-1, 3F-2, 3F-14,4F, 4F-P-4F, 4F-IHS-4F, 4F2, 5F, 6F, 7F, 18F, 5A, 5A-C1, 5A-CH1, 5A-CH2, 5A-H1, 18A, 37 pA [18A-P-18A], ELK [name], ELK-A, ELK-1F, ELK-1K1A1E, ELK-1L1K, ELK-1W, ELK-2A, ELK-2A2K2E, ELK-2E2K, ELK-2F, ELK-3E3EK, ELK-3E3K3A, ELK-3E3LK, ELK-PA, ELK-P2A, ELKA [name], ELKA-CH2, ATI-5261, CS-6253, ETC-642, FAMP [name], FREL [name] and KRES [name]) and apoE mimetics (e.g., Ac-hE18A-NH2 [AEM-28], Ac-[R]hE18A-NH$_2$, AEM-28-14, EpK, hEp, mR18L, COG-112, COG-133 and COG-1410);

omega-3 fatty acids, including docosahexaenoic acid (DHA), docosapentaenoic acid (DPA), eicosapentaenoic acid (EPA), α-linolenic acid (ALA), fish oils (which contain, e.g., DHA and EPA), and esters (e.g., glyceryl and ethyl esters) thereof; and analogs, derivatives and salts thereof.

In certain embodiments, the anti-obesity agent is or includes a lipase inhibitor (e.g., orlistat) or/and an antihyperlipidemic agent (e.g., a statin such as atorvastatin, or/and a fibrate such as fenofibrate).

Antihypertensive agents include without limitation:

antagonists of the renin-angiotensin-aldosterone system (RAAS), including renin inhibitors (e.g., aliskiren), angiotensin-converting enzyme (ACE) inhibitors (e.g., benazepril, captopril, enalapril, fosinopril, lisinopril, moexipril, perindopril, quinapril, ramipril and trandolapril), angiotensin II receptor type 1 (AT$_1$) antagonists (e.g., azilsartan, candesartan, eprosartan, fimasartan, irbesartan, losartan, olmesartan medoxomil, olmesartan, telmisartan and valsartan), and aldosterone receptor antagonists (e.g., eplerenone and spironolactone);

diuretics, including loop diuretics (e.g., bumetanide, ethacrynic acid, furosemide and torsemide), thiazide diuretics (e.g., bendroflumethiazide, chlorothiazide, hydrochlorothiazide, epitizide, methyclothiazide and polythiazide), thiazide-like diuretics (e.g., chlorthalidone, indapamide and metolazone), cicletanine (an early distal tubular diuretic), potassium-sparing diuretics (e.g., amiloride, eplerenone, spironolactone and triamterene), and theobromine;

calcium channel blockers, including dihydropyridines (e.g., amlodipine, levamlodipine, cilnidipine, clevidipine, felodipine, isradipine, lercanidipine, nicardipine, nifedipine, nimodipine, nisoldipine and nitrendipine) and non-dihydropyridines (e.g., diltiazem and verapamil);

α$_2$-adrenoreceptor agonists, including clonidine, guanabenz, guanfacine, methyldopa and moxonidine;

α$_1$-adrenoreceptor antagonists (alpha blockers), including doxazosin, indoramin, nicergoline, phenoxybenzamine, phentolamine, prazosin, terazosin and tolazoline;

β-adrenoreceptor ($β_1$ or/and $β_2$) antagonists (beta blockers), including atenolol, betaxolol, bisoprolol, carteolol, carvedilol, labetalol, metoprolol, nadolol, nebivolol, oxprenolol, penbutolol, pindolol, propranolol and timolol;

mixed alpha/beta blockers, including bucindolol, carvedilol and labetalol;

endothelin receptor antagonists, including selective $ET_A$ receptor antagonists (e.g., ambrisentan, atrasentan, edonentan, sitaxentan, zibotentan and BQ-123) and dual $ET_A/ET_B$ antagonists (e.g., bosentan, macitentan and tezosentan);

other vasodilators, including hydralazine, minoxidil, theobromine, sodium nitroprusside, organic nitrates (e.g., isosorbide mononitrate, isosorbide dinitrate and nitroglycerin, which are converted to nitric oxide in the body), endothelial nitric oxide synthase (eNOS) stimulators (e.g., cicletanine), activators of soluble guanylate cyclase (e.g., cinaciguat and riociguat), phosphodiesterase type 5 (PDE5) inhibitors (e.g., avanafil, benzamidenafil, dasantafil, dynafil, lodenafil, mirodenafil, sildenafil, tadalafil, udenafil, vardenafil, dipyridamole, papaverine, propentofylline, zaprinast and T-1032), prostaglandin $E_1$ (alprostadil) and analogs thereof (e.g., limaprost amd misoprostol), prostacyclin and analogs thereof (e.g., ataprost, beraprost [e.g., esuberaprost], 5,6,7-trinor-4,8-inter-m-phenylene-9-fluoro-$PGI_2$, carbacyclin, isocarbacyclin, clinprost, ciprostene, eptaloprost, cicaprost, iloprost, pimilprost, SM-10906 (des-methyl pimilprost), naxaprostene, taprostene, treprostinil, CS-570, OP-2507 and TY-11223), non-prostanoid prostacyclin receptor agonists (e.g., 1-phthalazinol, ralinepag, selexipag, ACT-333679 [MRE-269, active metabolite of selexipag], and TRA-418), phospholipase C (PLC) inhibitors, and protein kinase C (PKC) inhibitors (e.g., BIM-1, BIM-2, BIM-3, BIM-8, chelerythrine, cicletanine, gossypol, miyabenol C, myricitrin, ruboxistaurin and verbascoside;

minerals, including magnesium and magnesium sulfate; and analogs, derivatives and salts thereof.

In certain embodiments, the antihypertensive agent is or includes a thiazide or thiazide-like diuretic (e.g., hydrochlorothiazide or chlorthalidone), a calcium channel blocker (e.g., amlodipine or nifedipine), an ACE inhibitor (e.g., benazepril, captopril or perindopril) or an angiotensin II receptor antagonist (e.g., olmesartan medoxomil, olmesartan, telmisartan or valsartan), or any combination thereof.

In some embodiments, a peptide product described herein is used in combination with one or more additional therapeutic agents to treat NAFLD, such as NASH. In some embodiments, the one or more additional therapeutic agents are selected from antidiabetic agents, anti-obesity agents, anti-inflammatory agents, antifibrotic agents, antioxidants, anti-hypertensive agents, and combinations thereof.

Therapeutic agents that can be used to treat NAFLD (e.g., NASH) include without limitation:

PPAR agonists, including PPAR-δ agonists (e.g., MBX-8025, elafibranor [dual PPAR-α/δ agonist] and GW501516 [dual PPAR-β/δ agonist]) and PPAR-γ agonists (e.g., thiazolidinediones such as pioglitazone, and saroglitazar [dual PPAR-α/γ agonist])-PPAR-δ and-γ agonism increases insulin sensitivity, PPAR-α agonism reduces liver steatosis and PPAR-δ agonism inhibits activation of macrophages and Kupffer cells;

farnesoid X receptor (FXR) agonists, such as obeticholic acid and GS-9674-FXR agonists reduce liver gluconeogenesis, lipogenesis, steatosis and fibrosis;

fibroblast growth factor 19 (FGF19) and analogs and derivatives thereof, such as NGM-282-FGF19 analogs reduce liver gluconeogenesis and steatosis;

fibroblast growth factor 21 (FGF21) and analogs and derivatives thereof, such as BMS-986036 (pegylated FGF21)-FGF21 analogs reduce liver steatosis, cell injury and fibrosis;

HMG-CoA reductase inhibitors, including statins (e.g., rosuvastatin)-statins reduce steatohepatitis and fibrosis;

ACC inhibitors, such as NDI-010976 (liver-targeted) and GS-0976-ACC inhibitors reduce de novo lipogenesis and liver steatosis;

SCD-1 inhibitors, such as aramchol-SCD-1 inhibitors reduce liver steatosis and increase insulin sensitivity;

SGLT2 inhibitors, such as canagliflozin, ipragliflozin and luseogliflozin-SGLT2 inhibitors reduce body weight, liver ALT level and fibrosis;

antagonists of CCR2 or/and CCR5, such as cenicriviroc-antagonists of CCR2 (binds to CCL2 [MCP1]) and CCR5 (binds to CCL5 [RANTES]) inhibit activation and migration of inflammatory cells (e.g., macrophages) to the liver and reduce liver fibrosis;

apoptosis inhibitors, including apoptosis signal-regulating kinase 1 (ASK1) inhibitors (e.g., selonsertib) and caspase inhibitors (e.g., emricasan [pan-caspase inhibitor])-apoptosis inhibitors reduce liver steatosis and fibrosis;

lysyl oxidase-like 2 (LOXL2) inhibitors, such as simtuzumab-LOXL2 is a key matrix enzyme in collagen formation and is highly expressed in the liver;

galectin-3 inhibitors, such as GR-MD-02 and TD139-galectin-3 is critical for development of liver fibrosis;

antioxidants, including vitamin E (e.g., α-tocopherol) and scavengers of reactive oxygen species (ROS) and free radicals (e.g., cysteamine, glutathione, melatonin and pentoxifylline [also anti-inflammatory via inhibition of TNF-α and phosphodiesterases])-vitamin E reduces liver steatosis, hepatocyte ballooning and lobular inflammation; and analogs, derivatives and salts thereof.

In some embodiments, a peptide product described herein is used in conjunction with a PPAR agonist (e.g., a PPAR-δ agonist such as elafibranor or/and a PPAR-γ agonist such as pioglitazone), a HMG-CoA reductase inhibitor (e.g., a statin such as rosuvastatin), an FXR agonist (e.g., obeticholic acid) or an antioxidant (e.g., vitamin E), or any combination thereof, to treat NAFLD (e.g., NASH). In certain embodiments, the one or more additional therapeutic agents for treatment of NAFLD (e.g., NASH) are or include vitamin E or/and pioglitazone.

Preparation of Peptide Products

WO 2015/184177 A1 describes the synthesis of peptide products. The Examples below also describe the synthesis of representative peptide products.

EXAMPLES

The following examples are intended only to illustrate the disclosure. Other processes, assays, studies, protocols, procedures, methodologies, reagents and conditions may alternatively be used as appropriate.

Example 1. Reagents Such as N-α-Fmoc, N-ε-(1-Octyl β-D-Glucuronide-6-Yl)-L-Lysine In an oven-dried 250 mL Erlenmeyer flask is placed 1-octyl β-D-glucuronic acid (3.06 g, 10 mmol, Carbosynth Ltd.), 50 mL anhydrous DMF, and anhydrous 1-hydroxybenzotriazole (1.62 g, 12 mmol). A chilled (4° C.) solution of N, N'-dicyclohexylcarbodiimide (2.48 g, 12 mmol) in 50 mL of DMF is added with stirring, and the reaction is allowed to proceed for 5 min. The copious white precipitate of N, N'-dicyclohexylurea is filtered on a fritted glass funnel and the filtrate is added to a solution of N-α-Fmoc-L-lysine (3.68 g, 10 mmol) in 25 ml anhydrous DMF. The reaction is allowed to proceed for 25 min with warming to room temp or until the ninhydrin color is very faint. The reaction mixture is filtered, stripped to dryness and crystallized from MeOH/Et$_2$O by dissolution in MeOH and slow dilution to the cloud point with Et$_2$O, followed by refrigeration. Further purification can be achieved by silica gel chromatography using a solvent gradient from EtOAc to EtOAc/EtOH/AcOH.

A similar reaction using N-α-Boc-L-lysine yields N-α-Boc,N-F-(1-octyl 3-D-glucuronide-6-yl)-L-lysine, which is suitable for N-terminal incorporation and cleavage to a free N-terminus. A similar reaction using N-α-Ac-L-lysine yields N-α-Ac,N-F-(1-octyl 3-D-glucuronide-6-yl)-L-lysine, which is suitable for incorporation at the N-terminus of a peptide with a blocked N-terminus. A similar reaction using an appropriate amount of N-α-Fmoc-L-ornithine yields N-α-Fmoc,N-6-(1-octyl 3-D-glucuronide-6-yl)-L-ornithine. Similar reactions using other N-mono-protected diamino acids furnish the corresponding reagents. Alternatively, use of a transient Me$_3$Si ester protecting group during the coupling and without pre-activation of the 1-octyl β-D-glucuronic acid provides a facile route to the formation of the reagents. The transient Me$_3$Si ester is produced by reaction of the Fmoc-Lys-OH with an equimolar amount of N,O-bis(trimethylsilyl)acetamide in dichloromethane (CH$_2$C2). The organic layer contains the desired reagent as a solution in CH$_2$Cl$_2$ ready for coupling with the 1-alkyl glucoronide as above. The filtered reaction mixture is washed with aqueous NaHSO$_4$ to hydrolyze the Me$_3$Si ester and then is dried over MgSO$_4$, and then the solvent is removed.

Similarly, but using peracetyl or perbenzoyl 1-octyl β-D-glucuronic acid, one obtains the Ac- or Bz-protected form of the reagents (e.g. 2,3,4-trisacetyl 1-octyl β-D-glucuronic acid and the like, formed by treatment with Ac$_2$O). Such reagents have increased stability during acid cleavage from the resin and are used when instability during deprotection is detected. Final deprotection of such products is carried out by base-catalyzed transesterification after cleavage, by use of MeOH/NH$_3$, MeOH/NaOMe or MeOH/NH$_2$NH$_2$, as described above.

Example 2. Synthetic Peptides

In general, peptide synthesis methods involve the sequential addition of protected amino acids to a growing peptide chain. Normally, either the amino or carboxyl group of the first amino acid and any reactive side chain group are protected. This protected amino acid is then either attached to an inert solid support or utilized in solution, and the next amino acid in the sequence, also suitably protected, is added under conditions amenable to formation of the amide linkage. After all the desired amino acids have been linked in the proper sequence, protecting groups and any solid support are removed to afford the crude peptide. The peptide is desalted and purified chromatographically.

One method of preparing peptides having fewer than about fifty amino acids involves solid-phase peptide synthesis. In this method, the α-amino (Nα) group and any reactive side-chain functional groups are protected by acid- or base-sensitive groups. The protecting group should be stable to the conditions of peptide linkage formation, while being readily removable without affecting the extant peptide chain. Suitable α-amino protecting groups include, but are not limited to, t-butyloxycarbonyl (Boc), benzyloxycarbonyl (Cbz), o-chlorobenzyloxycarbonyl, biphenylisopropyloxycarbonyl, t-amyloxycarbonyl (Amoc), isobornyloxycarbonyl, α,α-dimethyl-3,5-dimethoxybenzyloxy-carbonyl, o-nitrophenylsulfenyl, 2-cyano-t-butoxycarbonyl, 9-fluorenylmethoxycarbonyl (Fmoc) and the like, preferably Boc or Fmoc. Suitable side-chain protecting groups include, but are not limited to, acetyl, benzyl (Bzl or Bn), benzyloxymethyl (Bom), Boc, t-butyl, o-bromobenzyloxycarbonyl, t-butyl, t-butyldimethylsilyl, 2-chlorobenzyl (Cl-z), 2,6-dichlorobenzyl, cyclohexyl, cyclopentyl, isopropyl, pivalyl, tetrahydropyran-2-yl, tosyl (Tos), 2,2,4,6,7-pentamethyldihydrobenzofuran-5-sulfonyl (Pbf), trimethylsilyl and trityl. A preferred Nα-protecting group for synthesis of the compounds is Fmoc. Preferred side-chain protecting groups include —O-t-butyl for Glu, Tyr, Thr, Asp and Ser; Boc for Lys and Trp side chains; Pbf for Arg; and Trt for Asn, Gln and His. For selective modification of a Lys residue, orthogonal protection with a protecting group not removed by reagents that cleave the Fmoc or t-butyl-based protecting groups is preferred. Preferred examples for modification of the Lys side chain include, but are not limited to, those removed by hydrazine but not piperidine—e.g., 1-(4,4-dimethyl-2,6-dioxocyclohex-1-ylidene)-3-methylbutyl (ivDde), 1-(4,4-dimethyl-2,6-dioxocyclohex-1-ylidene) ethyl (Dde) and allyloxycarbonyl (Alloc).

The Fmoc-Lys(ivDde) or Fmoc-Lys(Dde) protecting group scheme is preferred in cases where side-chain lactam formation is desired because Fmoc-Glu(O-allyl) and Fmoc-Lys(Alloc) can be incorporated and used to provide transient protection, and then deprotected for lactam formation while the Lys(Dde) protecting group remains for later removal and reaction with the functionalized surfactant. The side-chain lactam between acidic and basic residues (e.g. Glu and Lys) is carried out after removal of the allyl-based protecting group by activation of the carboxyl side-chain function with N,N'-diisopropylcarbodiimide (DIC)/1-hydroxybenzotriazole (HOBt) or 2-(1H-benzotriazole-1-yl)-1,1,3,3-tetramethylaminium hexafluorophosphate (HBTU)/N,N-di-isopropylethylamine (DIEA), using standard protocols in the art.

In solid-phase synthesis, the C-terminal amino acid is first attached to a suitable resin support. Suitable resin supports are those materials which are inert to the reagents and reaction conditions of the stepwise condensation and deprotection reactions, as well as being insoluble in the media used. Examples of commercially available resins include styrene/divinylbenzene resins modified with a reactive group, e.g., chloromethylated co-poly-(styrene-divinylbenzene), hydroxymethylated co-poly-(styrene-divinylbenzene), and the like. Benzylated, hydroxymethylated phenylacetamidomethyl (PAM) resin and hydroxymethylphenoxyacetylamidomethyl (HMPA) are preferred for the preparation of peptide C-terminal acids. When the C-terminus of the compound is an amide, preferred resins are p-methylbenzhydrylamino-co-poly(styrene-divinyl-benzene) resin and 2,4-dimethoxybenzhydrylamino-based resin ("Rink amide"), and the like. A preferred support for the synthesis of larger peptides is commercially available resins containing PEG sequences grafted onto other polymeric matrices, such as the Rink Amide-PEG and PAL-PEG-PS resins (Applied Biosystems) and similar resins designed for peptide amide synthesis using the Fmoc protocol. Thus, in certain cases it may be desirable to have an amide linkage to a PEG chain. In such cases it is convenient to link an N-Fmoc-amino-PEG-carboxylic acid to the amide-forming resin above (e.g. Rink amide resin and the like). The first amino acid of the chain can be coupled as an N-Fmoc-amino acid to the amino function of the PEG chain. Final deprotection yields the desired Peptide-NH-PEG-CO—$NH_2$ product.

Attachment to the PAM or HMPA resin may be accomplished by reaction of the Nα-protected amino acid, such as the Boc-amino acid, as its ammonium, cesium, triethylammonium, 1,5-diazabicyclo-[5.4.0]undec-5-ene, tetramethylammonium, or similar salt in ethanol, acetonitrile, N,N-dimethylformamide (DMF), and the like, preferably the cesium salt in DMF, with the resin at an elevated temperature, such as between about 40° C. and about 60° C., preferably about 50° C., for about 12 to 72 hours, preferably about 48 hours. This eventually yields the peptide acid product following acid cleavage or an amide following aminolysis.

The Nα-Boc-amino acid may be attached to the benzhydrylamine resin by means of, e.g., a DIC/HOBt-mediated coupling for about 2 to 24 hours, preferably about 2 hours, at a temperature between about 10 and about 50° C., preferably about 25° C., in a solvent such as $CH_2Cl_2$ or DMF, preferably $CH_2Cl_2$.

For Boc-based protocols, the successive coupling of protected amino acids may be carried out by methods known in the art, typically in an automated peptide synthesizer. Following neutralization with triethylamine, DIEA, N-methylmorpholine (NMM), collidine or similar base, each protected amino acid is introduced in approximately about 1.5- to 2.5-fold molar excess and the coupling carried out in an inert, nonaqueous, polar solvent such as $CH_2Cl_2$, DMF, N-methylpyrrolidone (NMP), N,N-dimethylacetamide (DMA), or a mixture thereof, preferably in dichloromethane at ambient temperature. For Fmoc-based protocols no acid is used for deprotection, but a base, preferably DIEA or NMM, is usually incorporated into the coupling mixture. Couplings are typically done in DMF, NMP, DMA or mixed solvents, preferably DMF. Representative coupling agents are N,N'-dicyclohexylcarbodiimide (DCC), N,N'-diisopropyl-carbodiimide (DIC) and other carbodiimides, either alone or in the presence of HOBt, O-acyl ureas, benzotriazol-1-yl-oxytris(pyrrolidino)phosphonium hexafluorophosphate (PyBop), N-hydroxysuccinimide, other N-hydroxyimides, or oximes. Alternatively, protected amino acid active esters (e.g. p-nitrophenyl, pentafluorophenyl and the like) or symmetrical anhydrides may be used. Preferred coupling agents are of the aminium/uronium class, such as HBTU, 0-(7-azabenzotriazole-1-yl)-1,1,3,3-tetramethyluronium hexafluorophosphate (HATU), 2-(6-Chloro-1H-benzotriazole-1-yl)-1,1,3,3-tetramethylaminium hexafluorophosphate (HCTU), and the like.

A preferred method of attachment to the Fmoc-PAL-PEG-PS resin may be accomplished by deprotection of the resin linker with 20% piperidine in DMF, followed by reaction of the N-α-Fmoc protected amino acid, about a 5-fold molar excess of the N-α-Fmoc-amino acid, using HBTU: diisopropylethylamine (DIEA) (1:2) in DMF in a microwave-assisted peptide synthesizer with a 5 min, 75° C. max. coupling cycle.

Peptides of the disclosure may contain a PEG group (dPEG) at the C-terminus. Such PEG groups can be short chains of polyethylene glycol with an amino terminus and a carboxyl terminus. Thus, they are essentially unnatural amino acids and are treated similarly to the other amino acids for synthesis. For example, Fmoc-amidooxy-dPEG4-acid is commercially available from Quanta Biodesign (#10213) and is attached to the Rink or HMPA resin at the first step of the synthesis in a manner similar to that used for the N-Fmoc or N-Boc amino acids described above. Deprotection with the standard strong acid conditions provides the corresponding short dPEG C-terminally modified peptide with the corresponding acid or amide C-terminus.

For an Fmoc-based protocol in a microwave-assisted peptide synthesizer, the N-α-Fmoc amino acid protecting group is removed with 20% piperidine in DMF containing 0.1 M 1-hydroxybenzotriazole (HOBt), in a double-deprotection protocol for 30 sec and then for 3 min with a temperature maximum set at 75° C. HOBt is added to the deprotection solution to reduce aspartimide formation. Coupling of the next amino acid then employs a 5-fold molar excess using HBTU:DIEA (1:2) with a 5 min, 75° C. max. double-coupling cycle.

At the end of the solid-phase synthesis, the fully protected peptide is removed from the resin. When the linkage to the resin support is of the benzyl ester type, cleavage may be effected by means of aminolysis with an alkylamine or fluoroalkylamine for peptides with an alkylamide C-terminus, or by ammonolysis using, e.g., ammonia/methanol or ammonia/ethanol for peptides with an unsubstituted amide C-terminus, at a temperature between about −10° C. and about 50° C., preferably at about 25° C., for about 12 to 24 hours, preferably about 18 hours. Peptides with a hydroxy C-terminus may be cleaved by HF or other strongly acidic deprotection regimen or by saponification. Alternatively, the peptide may be removed from the resin by transesterification using methanol for example, followed by aminolysis or saponification. The protected peptide may be purified by silica gel or reverse-phase HPLC.

The side-chain protecting groups may be removed from the peptide by treating the aminolysis product with, e.g., anhydrous liquid HF in the presence of anisole or other carbonium ion scavenger, treatment with HF/pyridine complex, treatment with tris(trifluoroacetyl)boron and trifluoroacetic acid, by reduction with hydrogen and palladium on carbon or polyvinylpyrrolidone, or by reduction with sodium in liquid ammonia, preferably with liquid HF and anisole at a temperature between about −10° C. and 10° C., preferably at about 0° C., for about 15 minutes to 2 hours, preferably about 1.5 hours.

For peptides on the benzhydrylamine-type resins, the resin cleavage and deprotection steps may be combined in a single step utilizing liquid HF and anisole as described above or preferably through the use of milder cleavage cocktails. For example, for the PAL-PEG-PS resin, a preferred method is the use of a double-deprotection protocol in a microwave-assisted peptide synthesizer using one of the mild cleavage cocktails known in the art, such as TFA/water/tri-iso-propylsilane/3,6-dioxa-1,8-octanedithiol (DODT) (92.5/2.5/2.5/2.5) for 18 min at 38° C. each time. Cleavage of alkyl glycoside-containing materials has shown survival of the alkyl glycoside linkage using protocols with TFA/water ratios in the 9/1 to 19/1 range. A typical cocktail is 94% TFA:2% EDT; 2% $H_2O$; 2% TIS. Typically the fully deprotected product is precipitated and washed with cold (−70° C. to 4° C.) $Et_2O$, dissolved in deionized water and lyophilized.

The peptide solution may be desalted (e.g. with BioRad AG-3® anion-exchange resin) and the peptide purified by a sequence of chromatographic steps employing any or all of the following types: ion exchange on a weakly basic resin in the acetate form; hydrophobic adsorption chromatography on underivatized co-poly(styrene-divinylbenzene) such as Amberlite® XAD; silica gel adsorption chromatography; ion-exchange chromatography on carboxymethylcellulose; partition chromatography on Sephadex® G-25 for example; counter-current distribution; supercritical fluid chromatography; and HPLC, especially reversed-phase HPLC on octyl- or octadecylsilylsilica (ODS) bonded phase column packing.

Provided herein are processes for preparing covalently modified peptides described herein and pharmaceutically acceptable salts thereof, which comprise sequentially condensing protected amino acids on a suitable resin support, removing the protecting groups and resin support, and purifying the product, to afford the covalently modified peptides. The processes can employ any protocol for peptide synthesis known in the art, such as microwave-assisted solid-phase synthesis. In some embodiments, the peptides are attached to an alkyl glycoside.

Example 3. Oxidation Method to Make Uronic Acids

To a solution of 1-dodecyl β-D-glucopyranoside (2.0 g, 5.74 mmol, Carbosynth) in 20 mL of acetonitrile and 20 mL of de-ionized (DI) water was added (diacetoxyiodo)benzene (4.4 g, 13.7 mmol, Fluka) and TEMPO (0.180 g, 1.15 mmol). The resulting mixture was stirred at room temperature for 20 hr. The reaction was followed by mass spectrometry (e.g., LCQ ESI) and upon completion, the reaction mixture was diluted with water and lyophilized to dryness to give 1.52 g (73% crude yield) of the crude product, 1-dodecyl β-D-glucuronic acid, as a white powder, which was used directly for the solid-phase synthesis without further purification. For longer alkyl groups, 1,4-dioxane was used instead of acetonitrile and the temperature was raised to as high as 30° C. In a similar manner are prepared the desired alkyl saccharide uronic acids used to make the products and reagents described herein.

In a like manner, but using, e.g., the corresponding 1-octyl, 1-decyl, 1-undecyl, 1-tetradecyl, 1-hexadecyl and 1-octadecyl glycosides (Anatrace, Maumee, Ohio), were prepared the desired 1-alkyl saccharide uronic acids which were used to make the products and reagents described herein. In a like manner, but using, e.g., the corresponding 1-octyl, 1-decyl, 1-undecyl, 1-tetradecyl, 1-hexadecyl and 1-octadecyl β-D-melibiosides or β-D-maltosides (Anatrace), were prepared the desired 1-alkyl disaccharide uronic acids which were used to make the products and reagents described herein.

Example 4. Preparation of Peptide Product with C-Terminal Amide (EU-A387)

A sample of Fmoc-His-Aib-Gln-Gly-Thr-Phe-Thr-Ser-Asp-Bip-Ser-Lys-Tyr-Leu-Glu-Ser-Lys(Alloc)-Rink amide resin (SEQ ID NO: 782) was prepared by sequential addition of Nα-Fmoc-protected amino acids as described in Example 1 and deprotected at the Lys-N-epsilon position by incubation with Pd(PPh$_3$)$_4$ (0.5 eq.) and DMBA (20 eq.) in DMF/CH$_2$Cl$_2$ (1:1) overnight in the dark at room temperature. Following washing by DMF/CH$_2$Cl$_2$, the Lys side chain was acylated with 1'-dodecyl β-D-glucuronic acid in DMF/CH$_2$Cl$_2$ using DIC/HOBt. Completion of the coupling was checked by ninhydrin, and the product was washed extensively with CH$_2$Cl$_2$.

The product resin was submitted to final deprotection and cleavage from the resin by treatment with a cleavage cocktail (94% TFA, 2% EDT, 2% H$_2$, 2% TIS) for a period of 240 min at room temperature. The mixture was treated with Et$_2$O to precipitate the product and washed extensively with Et$_2$O to yield the crude title peptide product after drying in vacuo.

Purification was carried out in two batches by reverse-phase (C18) HPLC. The crude peptide was loaded on a 4.1×25 cm HPLC column at a flow rate of 15 mL/min (15% organic modifier, acetic acid buffer) and eluted with a gradient from 15-45% buffer B in 60 min at 50° C. The product fraction was lyophilized to yield the title peptide product with a purity of 98% by analytical HPLC (18.6 min; 30-60% CH$_3$CN in 0.1% TFA)/mass spectrometry (M+1 peak=2382.14). In a similar manner were prepared other peptide products of the disclosure, the characterization of which is shown below.

The corresponding 1-methyl and 1-octyl analogs of the title compound are prepared in a similar manner, but using the reagents 1'-methyl β-D-glucuronic acid and 1'-octyl β-D-glucuronic acid (Carbosynth). The corresponding 1-decyl, 1-dodecyl, 1-tetradecyl, 1-hexadecyl, 1-octadecyl, 1-eicosyl and higher analogs are prepared using the corresponding monosaccharide and disaccharide uronic acids, prepared as described above. Alternatively, the 1-alkyl glucuronyl, or other uronic acylated analogs, may be prepared by initial purification of the deprotected or partially deprotected peptide followed by acylation by the desired uronic acid.

Example 5. Preparation of Peptide Products with C-Terminal Acid

A sample of Boc-His(Trt)-Aib-Gln(Trt)-Gly-Thr(tBu)-Phe-Thr(tBu)-Ser(tBu)-Asp(OtBu)-Tyr(tBu)-Ser(tBu)-Lys (Boc)-Tyr(tBu)-Leu-Asp(OtBu)-Glu(O-Allyl)-Gln(Trt)-Ala-Ala-Lys(Alloc)-Glu(O-tBu)-Phe-Ile-Lys(Dde)-Trp (Boc)-Leu-Leu- Gln(Trt)-Thr(tBu)-HMPA (SEQ ID NO: 783) resin (started from Fmoc-Thr(tBu)-HMPA) resin, substitution 0.45 mmol/g) was prepared by sequential addition of Nα-Fmoc-protected amino acids as described in Example 1. The allyl-protected side chains of Glu and Lys residues were deprotected by incubation with Pd(PPh$_3$)$_4$ (0.5 eq.) and DMBA (20 eq.) in DMF/CH$_2$Cl$_2$ (1:1) overnight in the dark at room temperature. The resin was washed with 0.5% DIEA in DMF (twice), 0.5% sodium diethyldithiocarbamate in DMF (twice), and DMF/CH$_2$Cl$_2$ until a light yellow resin was obtained. A side-chain lactam was formed by coupling the Glu and Lys residues with DIC/HOBT (5 eq.) in DMF. The reaction was checked for completeness with ninhydrin and recoupled if necessary. Following washing with DMF/CH$_2$Cl$_2$, the Lys side chain was deprotected by incubation with 5% hydrazine hydrate in DMF (10 eq.) twice, in each case for 15 min. Following washing with DMF/CH$_2$Cl$_2$, the side-chain amino group of the deprotected Lys residue was reacted with 1'-tetradecyl β-D-melibiouronic acid in DMF/CH$_2$Cl$_2$ using DIC/HOBt. Completion of the coupling was checked by ninhydrin, and the product was washed extensively with CH$_2$Cl$_2$. Any coupling which was not complete by ninhydrin was rerun. In general, 10-12 g of peptide product resin was obtained from a 2 mmole synthesis.

The product resin was submitted to final deprotection and cleavage from the resin by treatment with a cleavage cocktail (94% TFA, 2% EDT, 2% H$_2$O, 2% TIS) for a period of 240 min at room temperature. The mixture was treated with Et$_2$O to precipitate the product and washed extensively with Et$_2$O to yield the crude title peptide product after drying in vacuo. In general, 5-8 g of crude peptide product was obtained.

Purification was carried out in two batches by reverse-phase (C18) HPLC. The crude peptide (1-1.5 g) was loaded on a 4.1×25 cm HPLC column at a flow rate of 15 mL/min (15% organic modifier, 0.1% TFA buffer) and eluted with a gradient from 35-55% buffer B in 70 min at room temperature. Repurification of the less pure fractions was done for the fractions with a purity of >70%. The product fraction was lyophilized to yield EU-A1077 with a purity of 98.7% by analytical HPLC (10.3 min, 45-75% $CH_3CN$ in 0.1% TFA)/mass spectrometry (1317.67, +3 charged; 1976.13, +2 charged; molecular weight 3950.44). In a similar manner were prepared other peptide products of the disclosure, whose characterization is shown below.

The corresponding 1-methyl and 1-octyl analogs of the title compound are prepared in a similar manner, but using the reagents 1'-methyl β-D-glucuronic acid and 1'-octyl β-D-glucuronic acid (Carbosynth). In a like manner, but using the corresponding 1-octyl, 1-decyl, 1-undecyl, 1-tetradecyl, 1-hexadecyl and 1-octadecyl β-D-glucouronic acids (prepared as described above), were prepared peptide products of the disclosure. In a like manner, but using the corresponding 1-octyl, 1-decyl, 1-undecyl, 1-tetradecyl, 1-hexadecyl and 1-octadecyl β-D-melibiouronic acids or β-D-maltouronic acids (prepared as described above), were prepared peptide products of the disclosure. Alternatively, the 1-alkyl glucuronyl, or other uronic acylated analogs, may be prepared by initial purification of the deprotected or partially deprotected peptide followed by acylation by the desired uronic acid reagent. Alternatively, ammonolysis of the HMPA resin-bound intermediate yields the corresponding C-terminal amide.

Analysis and characterization was done by HPLC/mass spectrometry in positive ion mode using the eluent gradients given in the table below.

| Compound Number | Molecular Wt Expected | Molecular Wt Found | HPLC (min; elution) |
|---|---|---|---|
| EU-A387 | 2379.66 | 2380.14 | 18.6 [b] |
| EU-A388 | 2393.69 | 2393.74 | 16.0 [a] |
| EU-A391 | 2317.62 | 2318.26 | 11.2 [b] |
| EU-A455 | 2988.36 | 2988.00 | 11.5 [b] |
| EU-A474 | 2570.86 | 2570.54 | 11.3 [b] |
| EU-A478 | 2459.75 | 2459.74 | 11.1 [b] |
| EU-A484 | 2544.86 | 2545.06 | 9.6 [b] |
| EU-A501 | 2904.2 | 2903.34 | 7.9 [b] |
| EU-A502 | 2776.07 | 2776.14 | 8.0 [b] |
| EU-A503 | 2704.98 | 2704.40 | 8.0 [b] |
| EU-A504 | 2548.80 | 2548.00 | 9.1 [b] |
| EU-A505 | 2392.61 | 2392.40 | 10.5 [b] |
| EU-A506 | 2305.53 | 2305.06 | 10.7 [b] |
| EU-A507 | 3763.23 | 3762.66 | 9.0 [b] |
| EU-A521 | 2303.56 | 2303.60 | 8.2 [c] |
| EU-A522 | 2315.60 | 2315.60 | 14.2 [d] |
| EU-A523 | 2615.94 | 2616.00 | 8.1 [b] |
| EU-A524 | 2459.75 | 2459.74 | 12.7 [d] |
| EU-A525 | 2459.75 | 2459.06 | 6.0 [c] |
| EU-A526 | 2473.75 | 2473.60 | 12.7 [d] |
| EU-A527 | 2390.64 | 2390.40 | 14.6 [d] |
| EU-A529 | 2546.83 | 2546.80 | 9.5 [b] |
| EU-A531 | 2546.83 | 2546.80 | 9.5 [b] |
| EU-A532 | 2559.00 | 2558.66 | 9.6 [b] |
| EU-A533 | 2560.96 | 2560.66 | 9.5 [b] |
| EU-A534 | 2544.99 | 2544.94 | 9.7 [b] |
| EU-A535 | 2573.05 | 2574.00 | 12.0 [b] |
| EU-A536 | 2602.96 | 2603.46 | 14.3 [b] |
| EU-A538 | 2516.99 | 2516.40 | 10.3 [b] |
| EU-A539 | 2657.20 | 2656.80 | 10.8 [b] |
| EU-A540 | 2685.20 | 2684.94 | 9.8 [c] |
| EU-A541 | 2713.20 | 2712.80 | 13.0 [c] |
| EU-A544 | 2631.94 | 2632.26 | 10.8 [b] |
| EU-A546 | 2687.93 | 2688.80 | 9.1 [c] |
| EU-A549 | 2388.67 | 2388.66 | 6.3 [e] |
| EU-A551 | 2444.67 | 2445.20 | 11.4 [e] |
| EU-A552 | 2472.67 | 2473.14 | 10.7 [f] |
| EU-A554 | 2560.86 | 2560.40 | 10.3 [c] |
| EU-A556 | 2616.86 | 2616.40 | 11.7 [e] |

-continued

| Compound Number | Molecular Wt Expected | Molecular Wt Found | HPLC (min; elution) |
|---|---|---|---|
| EU-A557 | 2644.86 | 2645.74 | 10.4 [f] |
| EU-A560 | 2570.86 | 2571.06 | 8.3 [c] |
| EU-A562 | 2626.86 | 2626.66 | 9.9 [e] |
| EU-A563 | 2654.86 | 2655.06 | 8.7 [f] |
| EU-A565 | 2542.80 | 2542.54 | 9.5 [c] |
| EU-A567 | 2598.80 | 2599.06 | 12.0 [e] |
| EU-A568 | 2626.80 | 2626.54 | 10.1 [f] |

HPLC gradients in 0.1% TFA:
[a] 35 to 65% $CH_3CN$ over 30 min
[b] 30 to 60% $CH_3CN$ over 20 min
[c] 35 to 65% $CH_3CN$ over 20 min
[d] 25 to 55% $CH_3CN$ over 20 min
[e] 40 to 70% $CH_3CN$ over 20 min
[f] 45 to 75% $CH_3CN$ over 20 min
HPLC was carried out on a Phenomenex Luna C18 5 micron 250 × 4.6 mm analytical column.

The following table lists other compounds synthesized and analyzed as described above:

| Compound Number | Molecular Wt Expected | Molecular Wt Found | HPLC (min; elution) |
|---|---|---|---|
| EU-A570 | 2656.16 | 2656.00 | 10.4 [b] |
| EU-A571 | 2684.16 | 2683.34 | 11.2 [c] |
| EU-A575 | 2670.16 | 2670.94 | 11.8 [b] |
| EU-A576 | 2698.16 | 2697.20 | 11.2 [c] |
| EU-A580 | 2668.20 | 2667.20 | 12.3 [b] |
| EU-A581 | 2696.20 | 2695.46 | 11.1 [c] |
| EU-A592 | 2724.20 | 2724.58 | 9.9 [e] |
| EU-A595 | 2682.20 | 2682.40 | 9.7 [c] |
| EU-A596 | 2710.20 | 2710.46 | 10.4 [c] |
| EU-A597 | 2738.20 | 2738.18 | 10.9 [e] |
| EU-A721 | 2461.85 | 2461.74 | 10.3 [b] |
| EU-A722 | 2475.85 | 2475.34 | 10.8 [b] |
| EU-A723 | 2459.88 | 2459.86 | 7.7 [c] |
| EU-A724 | 2473.88 | 2473.34 | 11.1 [b] |
| EU-A725 | 2471.92 | 2472.00 | 10.8 [b] |
| EU-A726 | 2557.03 | 2556.80 | 11.0 [b] |
| EU-A727 | 2485.92 | 2485.74 | 10.9 [b] |
| EU-A728 | 2513.92 | 2513.86 | 10.6 [c] |
| EU-A729 | 2541.92 | 2541.86 | 9.7 [e] |
| EU-A730 | 2569.92 | 2569.74 | 9.4 [f] |
| EU-A731 | 2425.88 | 2425.32 | 10.6 [d] |
| EU-A732 | 2476.95 | 2476.40 | 9.4 [c] |
| EU-A733 | 2381.83 | 2382.02 | 11.4 [b] |
| EU-A734 | 2616.09 | 2616.18 | 11.4 [b] |
| EU-A750 | 1611.89 | 1611.56 | 9.4 [c] |
| EU-A751 | 1625.89 | 1625.35 | 9.7 [c] |
| EU-A752 | 1709.93 | 1709.41 | 11.7 [g] |
| EU-A753 | 1637.84 | 1637.46 | 12.5 [b] |
| EU-A754 | 1651.84 | 1651.18 | 9.9 [c] |
| EU-A755 | 1711.93 | 1711.46 | 10.3 [h] |
| EU-A756 | 1671.98 | 1671.37 | 9.8 [e] |
| EU-A757 | 1770.02 | 1769.17 | 14.9 [g] |
| EU-A770 | 3333.61 | 3334.65 | 9.5 [b] |
| EU-A771 | 3678.25 | 3677.96 | 11.3 [c] |
| EU-A772 | 3762.25 | 3763.35 | 14.9 [e] |
| EU-A773 | 3790.31 | 3791.31 | 11.1 [f] |
| EU-A774 | 3475.74 | 3477.15 | 10.5 [d] |
| EU-A775 | 3820.38 | 3821.52 | 10.4 [c] |
| EU-A776 | 3904.38 | 3905.76 | 10.2 [f] |
| EU-A777 | 3932.44 | 3933.69 | 9.7 [f] |
| EU-A792 | 3793.43 | 3793.52 | 8.9 [f] |
| EU-A793 | 3821.43 | 3821.60 | 10.8 [f] |
| EU-A794 | 3849.43 | 3848.78 | 10.5 [g] |
| EU-A945 | 3777.18 | 3777.54 | 12.2 [e] |
| EU-A948 | 3861.18 | 3862.14 | 13.0 [f] |
| EU-A993 | 3759.22 | 3759.00 | 9.3 [f] |
| EU-A994 | 3787.22 | 3787.44 | 11.4 [f] |
| EU-A995 | 3815.22 | 3815.52 | 14.5 [g] |
| EU-A996 | 3843.22 | 3843.12 | 12.3 [g] |
| EU-A999 | 3935.35 | 3934.66 | 13.4 [e] |
| EU-A1011 | 3854.21 | 3854.38 | 14.2 [c] |

| Compound Number | Molecular Wt Expected | Molecular Wt Found | HPLC (min; elution) |
|---|---|---|---|
| EU-A1017 | 3896.26 | 3895.77 | 12.3 [c] |
| EU-A1023 | 3921.35 | 3921.15 | 10.5 [e] |
| EU-A1024 | 3949.42 | 3950.22 | 5.8 [g] |
| EU-A1025 | 3977.47 | 3976.84 | 7.96 [g] |
| EU-A1026 | 4005.55 | 4004.64 | 12.8 [g] |
| EU-A1029 | 3939.31 | 3939.06 | 10.7 [e] |
| EU-A1032 | 4023.51 | 4025.22 | 13.9 [f] |
| EU-A1035 | 3840.21 | 3838.21 | 9.8 [e] |
| EU-A1041 | 3882.26 | 3880.50 | 9.6 [e] |
| EU-A1044 | 3966.46 | 3965.46 | 12.6 [f] |
| EU-A1167 | 3731.15 | 3731.42 | 8.9 [f] |
| EU-A1168 | 3745.15 | 3745.20 | 10.8 [i] |
| EU-A1173 | 3978.49 | 3977.00 | 12.9 [f] |
| EU-A1576 | 3922.37 | 3922.08 | 10.2 [e] |
| EU-A1577 | 3950.44 | 3949.95 | 10.3 [f] |
| EU-A1581 | 3923.35 | 3921.21 | 13.1 [j] |
| EU-A1587 | 3949.42 | 3949.92 | 9.6 [f] |
| EU-A1588 | 3977.47 | 3977.97 | 8.3 [f] |
| EU-A1589 | 4005.55 | 4005.18 | 9.2 [g] |
| EU-A1590 | 3922.37 | 3923.01 | 12.5 [j] |
| EU-A1591 | 3922.33 | 3922.80 | 12.4 [j] |
| EU-A1592 | 3923.35 | 3921.74 | 13.0 [j] |
| EU-A1595 | 3914.38 | 3915.45 | 11.5 [e] |
| EU-A1596 | 3942.43 | 3942.48 | 7.1 [g] |
| EU-A1598 | 3887.29 | 3886.80 | 12.4 [j] |
| EU-A1599 | 3888.31 | 3888.00 | 12.5 [j] |
| EU-A1601 | 4049.52 | 4051.35 | 10.1 [e] |
| EU-A1602 | 4077.59 | 4075.41 | 12.4 [n] |
| EU-A1606 | 4050.46 | 4051.77 | 10.4 [e] |
| EU-A1607 | 4078.53 | 4077.99 | 12.7 [n] |
| EU-A1611 | 4050.54 | 4051.44 | 10.1 [e] |
| EU-A1612 | 4078.61 | 4078.86 | 12.3 [e] |
| EU-A1617 | 4079.55 | 4079.55 | 13.0 [j] |
| EU-A1620 | 4180.59 | 4181.49 | 11.0 [e] |
| EU-A1622 | 4208.66 | 4208.31 | 12.9 [j] |
| EU-A1627 | 4207.64 | 4208.28 | 12.8 [j] |
| EU-A1634 | 4035.78 | 4037.34 | 13.9 [e] |
| EU-A1635 | 4063.78 | 4065.54 | 9.5 [g] |
| EU-A1639 | 4169.54 | 4167.99 | 7.7 [k] |
| EU-A1645 | 4183.76 | 4182.60 | 13.2 [e] |
| EU-A1646 | 4211.99 | 4213.32 | 23.5 [l] |
| EU-A1647 | 4239.74 | 4239.21 | 12.2 [m] |
| EU-A1651 | 4345.89 | 4345.41 | 10.8 [o] |
| EU-A1679 | 3704.17 | 3704.85 | 9.0 [e] |
| EU-A1680 | 3732.17 | 3732.45 | 7.0 [f] |
| EU-A1681 | 3760.24 | 3761.31 | 8.8 [f] |
| EU-A1682 | 3788.24 | 3788.52 | 11.9 [f] |
| EU-A1710 | 3859.32 | 3859.71 | 6.4 [f] |
| EU-A1711 | 3887.39 | 3888.12 | 8.0 [f] |
| EU-A1712 | 3915.39 | 3915.72 | 12.1 [e] |
| EU-A1713 | 3943.39 | 3943.32 | 11.2 [f] |
| EU-A1716 | 3860.26 | 3860.49 | 9.8 [e] |
| EU-A1717 | 3888.33 | 3889.23 | 8.4 [f] |
| EU-A1718 | 3916.33 | 3916.98 | 12.6 [f] |
| EU-A1719 | 3944.33 | 3944.31 | 9.0 [g] |
| EU-A1722 | 3989.37 | 3990.03 | 6.1 [f] |
| EU-A1723 | 4017.44 | 4017.54 | 7.8 [f] |
| EU-A1730 | 3916.35 | 3917.76 | 7.8 [f] |
| EU-A1734 | 3726.10 | 3726.63 | 14.0 [e] |
| EU-A1735 | 3754.10 | 3754.26 | 12.9 [f] |
| EU-A1739 | 3949.38 | 3950.31 | 13.0 [f] |
| EU-A1740 | 3977.43 | 3978.30 | 8.9 [g] |
| EU-A1745 | 3815.18 | 3815.10 | 13.8 [g] |
| EU-A1784 | 3915.35 | 3917.31 | 11.0 [f] |
| EU-A1785 | 3943.35 | 3944.40 | 14.6 [i] |
| EU-A1787 | 3916.25 | 3917.46 | 9.1 [g] |
| EU-A1788 | 3944.29 | 3945.45 | 10.8 [f] |
| EU-A1841 | 3788.20 | 3789.36 | 6.6 [f] |
| EU-A1842 | 3816.20 | 3817.80 | 11.3 [m] |
| EU-A1847 | 3727.08 | 3728.46 | 10.9 [f] |
| EU-A1848 | 3755.08 | 3756.96 | 10.2 [g] |

HPLC gradients in 0.1% TFA:
[a] 35 to 65% CH$_3$CN over 30 min
[b] 30 to 60% CH$_3$CN over 20 min
[c] 35 to 65% CH$_3$CN over 20 min
[d] 25 to 55% CH$_3$CN over 20 min
[e] 40 to 70% CH$_3$CN over 20 min
[f] 45 to 75% CH$_3$CN over 20 min
[g] 50 to 80% CH$_3$CN over 20 min
[h] 10 to 40% CH$_3$CN over 20 min
[i] 30 to 90% CH$_3$CN over 20 min
[j] 10 to 90% CH$_3$CN over 20 min
[k] 30 to 95% CH$_3$CN over 20 min
[l] 30 to 60% CH$_3$CN over 30 min
[m] 20 to 100% CH$_3$CN over 20 min
[n] 20 to 80% CH$_3$CN over 20 min
[o] 30 to 50% CH$_3$CN over 20 min
HPLC was carried out on a Phenomenex Luna C18 5 micron 250 × 4.6 mm analytical column.

Example 6. In Vitro Stability of Peptide Products in Human Plasma

One mg/mL stock solution was prepared in DMSO/CH$_3$CN (1/1). Standard working solutions in 50% CH$_3$CN were prepared with the stock solution. The concentrations of the working solutions were 20, 50, 100, 200, 500, 1000, 2000, 5000, 10000 and 20000 ng/mL. Ten μL of the working solutions was spiked into 90 μL blank plasma, and the mixture was vortexed. 300 μL of internal standard solution (verapamil, 20 ng/mL in 100% CH$_3$CN) was added, and the mixture was vortexed and centrifuged. The supernatant was transferred to an HPLC injection plate for loading onto the HPLC column. The standard samples were at 2, 5, 10, 20, 50, 100, 200, 500, 1000 and 2000 ng/mL. The QC samples were at 5 (LQC), 50 (MQC) and 500 (HQC) ng/mL. For the plasma-stability study, samples of EU-A993, EU-A1023 and human GLP-1(7-36) (Bachem) were prepared in human plasma (about 6-20 ng/mL or similar concentrations above the limit of quantitation) and sampled at time points t=0, 0.5, 1, 2, 4 and 8 hr during incubation at 30° C. Samples were treated with internal standard solution (100% CH$_3$CN) as described above in order to precipitate the peptides, and supernatants were loaded into an injection plate for loading into the HPLC column for quantitation by mass spectrometry.

Instruments used were: API-4000 Mass Spectrometer, ESI positive, MRM scan; and Shimadzu HPLC/CTC Autosampler with ACE C8 column (2.1×50 mm, 5 μm), mobile phase A: 0.1% formic acid and 5 mM NH4OAc in water, mobile phase B: 0.1% formic acid in CH$_3$CN, 10 μL of sample was injected.

Figure 8:
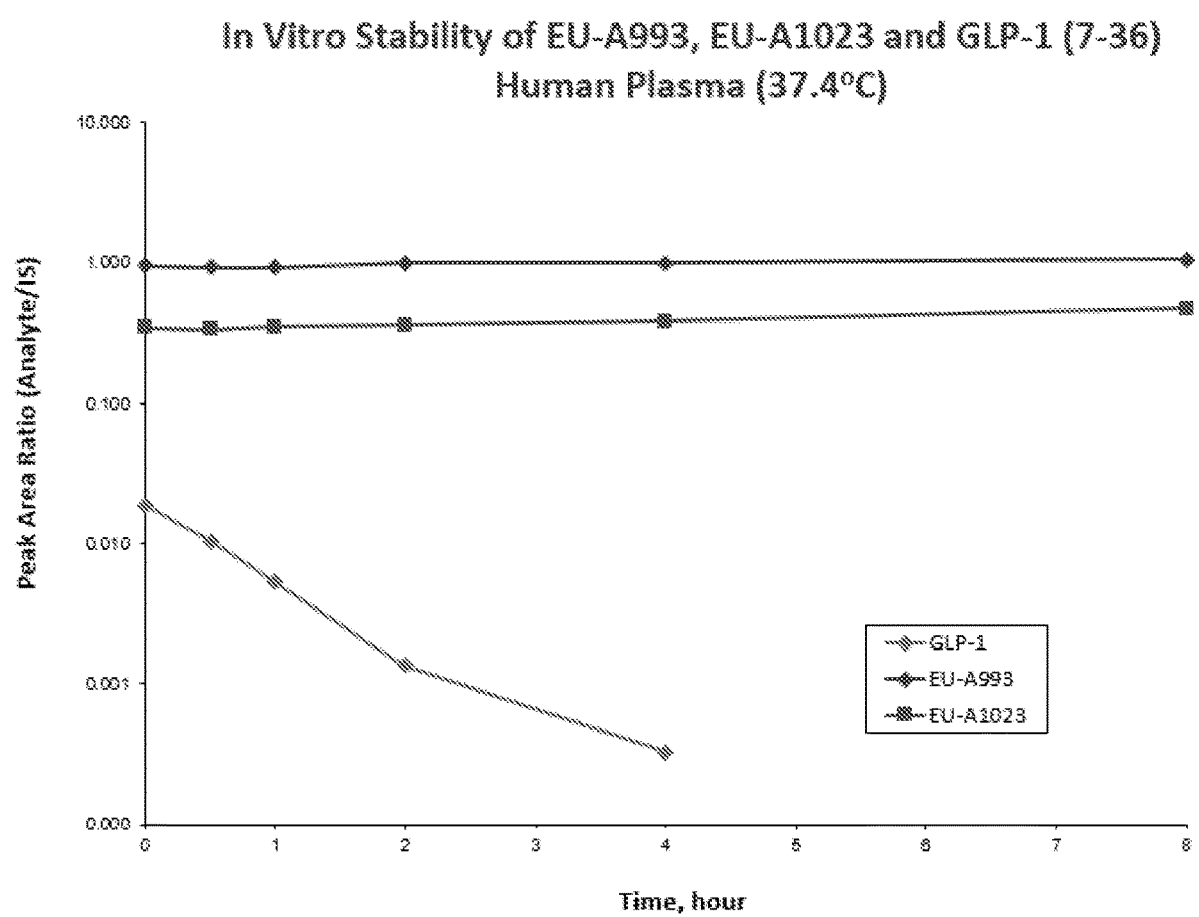
FIG. 8 shows the concentrations of the peptide products EU-A993 and EU-A1023 and the native hormone GLP-1 (7-36) over time during incubation in human plasma at 37° C.

A plot of compound signal (amount) versus time shows essentially complete cleavage of GLP-1(7-36) in 4 hours, but no detectable change in the amount of intact peptide products in human plasma over a period of at least 8 hours (FIG. 8). Both peptide products exhibited protection from proteolysis and a long plasma half-life in the in vitro assay.

Example 7. Cell Assay of Activity of Peptide Products at GLP-1 and Glucagon Receptors Compounds were weighed precisely in an amount of about 1 mg and assayed in standard cellular assays (Cerep SA). The readout was the amount of cAMP generated in the cells treated with the test compounds, in either agonist or antagonist mode. The assay used was the stimulation of cAMP levels in the glucagon (human, cloned into CHO cells) and GLP-1 (murine cell line) cellular assays. The assays are described in Chicchi et al., *J. Biol. Chem.*, 272:7765-7769 (1997) and Runge et al., *Br. J. Pharmacol.*, 138:787-794 (2003).

For EU-A391, the GCGR cellular response did not change, and the GLP1R cellular response rose steeply with an $EC_{50}$ of 420 nM.

| Compound Number | 1-Alkyl | $EC_{50}$ GLP-1 R (nM) | $EC_{50}$ Glucagon R (nM) |
| --- | --- | --- | --- |
| EU-A391 | 1-dodecyl | 420 | n.c. |
| EU-A455 | 1-dodecyl | 59 | 770 |
| EU-A474 | 1-dodecyl | 3000 | n.c. |
| EU-A478 | 1-dodecyl | n.c. | n.c. |
| EU-A484 | 1-dodecyl | n.c. | n.c. |
| EU-A501 | 1-dodecyl | 20000 | 12000 |
| EU-A502 | 1-dodecyl | 9400 | n.c. |
| EU-A503 | 1-dodecyl | n.c. | n.c. |
| EU-A504 | 1-dodecyl | 3100 | 1100 |
| EU-A505 | 1-dodecyl | 8500 | 6100 |
| EU-A506 | 1-dodecyl | 4600 | 1300 |
| EU-A507 | 1-dodecyl | 18 | 1 |
| EU-A521 | 1-dodecyl | n.c. | n.c. |
| EU-A522 | 1-dodecyl | n.c. | 9000 |
| EU-A523 | 1-dodecyl | n.c. | n.c. |
| EU-A524 | 1-dodecyl | n.c. | n.c. |
| EU-A525 | 1-dodecyl | n.c. | n.c. |
| EU-A526 | 1-dodecyl | n.c. | n.c. |
| EU-A527 | 1-dodecyl | n.c. | 5000 |
| EU-A529 | 1-dodecyl | n.c. | 7000 |
| EU-A531 | 1-dodecyl | 2100 | 1100 |
| EU-A532 | 1-dodecyl | 5000 | 2600 |
| EU-A533 | 1-dodecyl | 770 | 780 |
| EU-A534 | 1-dodecyl | 290 | 1900 |
| EU-A535 | 1-tetradecyl | §4800 | 2100 |
| EU-A536 | 1-hexadecyl | >10000 | 4400 |
| EU-A538 | 1-dodecyl | 270 | n.c. |
| EU-A539 | 1-dodecyl | 860 | 2300 |
| EU-A540 | 1-tetradecyl | n.c. | 8800 |
| EU-A541 | 1-hexadecyl | 800 | 5000 | n.c. means $EC_{50}$ not calculable
§means superagonist

A further series of cellular assays was carried out with standard cellular assays (DiscoveRx, LeadHunter assays) using readout of cAMP stimulation or arrestin activation. Compounds were weighed precisely in an amount of about 1 mg and shipped to DiscoveRx for dilution and assay. The cellular assays used human glucagon receptor cloned into CHO cells and human GLP-1 receptor cloned into CHO cells.

| Compound Number | $EC_{50}$ cAMP GLP-1 R (nM) | $EC_{50}$ Arrestin GLP-1 R (nM) | $EC_{50}$ cAMP Glucagon R (nM) | $EC_{50}$ Arrestin Glucagon R (nM) |
| --- | --- | --- | --- | --- |
| EU-A507 | 0.01 | 9 | 0.02 | 100 |
| EU-A534 | 87 | | 1100 | |
| EU-A538 | 55 | | 3500 | |
| EU-A750 | >1000 | | >1000 | |
| EU-A751 | >1000 | | >1000 | |
| EU-A752 | 146 | | >1000 | |
| EU-A753 | >1000 | | >1000 | |
| EU-A754 | 360 | | >1000 | |
| EU-A755 | 486 | | 471 | |
| EU-A756 | 611 | | >1000 | |
| EU-A757 | 6.7 | | >1000 | |
| EU-A770 | 0.01 | 2.3 | 0.5 | >100 |
| EU-A771 | 0.07 | 14.2 | 0.4 | >100 |
| EU-A772 | 0.07 | 8.4 | 5.4 | >100 |
| EU-A773 | 0.08 | 8.3 | 1.5 | >100 |
| EU-A774 | 0.009 | 6.8 | 0.15 | 22.7 |
| EU-A775 | 0.16 | 17 | 0.3 | 33.6 |
| EU-A776 | 1.2 | >100 | 6.5 | >100 |
| EU-A777 | 0.1 | 34.5 | 0.6 | 73 |
| EU-A792 | <0.05 | 27.9 | <0.05 | |
| EU-A793 | <0.05 | 23.8 | <0.05 | |
| EU-A794 | 0.05 | 59.4 | 0.18 | |
| EU-A945 | <0.05 | 9.4 | 0.06 | |
| EU-A948 | 0.08 | 25.6 | 9.1 | |
| EU-A992 | 0.009 | | 0.019 | |
| EU-A993 | <0.05 | 12.3 | <0.05 | |
| EU-A994 | 0.05 | 10.2 | <0.05 | |
| EU-A995 | 0.035 | 59.5 | 0.15 | |
| EU-A996 | 0.05 | >100 | 0.87 | |
| EU-A999 | 0.05 | | 0.015 | |
| EU-A1011 | 0.16 | | 0.51 | |
| EU-A1017 | 0.44 | | 0.10 | |
| EU-A1023 | 0.028 | | 0.035 | |
| EU-A1024 | 0.005 | | 0.035 | |
| EU-A1025 | 0.008 | | 0.240 | |
| EU-A1026 | 0.034 | | 0.486 | |
| EU-A1029 | 0.019 | | 0.06 | |
| EU-A1032 | 0.03 | | 5.4 | |
| EU-A1035 | 0.02 | | 0.19 | |
| EU-A1041 | 0.02 | | 0.13 | |
| EU-A1044 | 0.07 | | 0.57 | |
| EU-A1167 | 0.013 | | 0.019 | |
| EU-A1168 | 0.07 | | 0.14 | |
| EU-A1173 | 0.021 | | 0.463 | |
| EU-A1576 | 0.032 | | 0.070 | |
| EU-A1577 | 0.007 | | 0.069 | |
| EU-A1578 | 0.008 | | 0.355 | |
| EU-A1581 | 0.086 | | 1.032 | |
| EU-A1586 | 0.029 | | 0.107 | |
| EU-A1587 | 0.081 | | 0.253 | |
| EU-A1588 | 0.023 | | 0.043 | |
| EU-A1589 | 0.236 | | 0.655 | |
| EU-A1590 | 0.094 | | 0.343 | |
| EU-A1591 | 0.073 | | 0.286 | |
| EU-A1592 | 0.25 | | 0.78 | |
| EU-A1594 | 0.011 | | 0.068 | |
| EU-A1595 | 0.021 | | 0.113 | |
| EU-A1596 | 0.493 | | 1.230 | |
| EU-A1598 | 0.026 | | 0.199 | |
| EU-A1599 | 0.061 | | 0.317 | |
| EU-A1601 | 0.007 | | 0.048 | |
| EU-A1602 | 0.035 | | 0.162 | |
| EU-A1606 | 0.017 | | 0.058 | |
| EU-A1607 | 0.022 | | 0.126 | |
| EU-A1611 | 0.015 | | 0.16 | |
| EU-A1612 | 0.011 | | 0.059 | |
| EU-A1616 | 0.079 | | 0.204 | |
| EU-A1617 | 0.119 | | 0.598 | |
| EU-A1620 | 0.051 | | 0.24 | |
| EU-A1622 | 0.774 | | 2.08 | |
| EU-A1627 | 0.304 | | 0.705 | |
| EU-A1633 | 0.008 | | 0.053 | |
| EU-A1634 | 0.052 | | 0.493 | |
| EU-A1635 | 0.071 | | 1.983 | |
| EU-A1639 | 0.385 | | 2.292 | |
| EU-A1645 | 0.029 | | 0.091 | |
| EU-A1646 | 0.029 | | 0.332 | |
| EU-A1647 | 0.113 | | 1.895 | |
| EU-A1651 | 0.033 | | 0.149 | |
| EU-A1679 | 0.009 | | 0.14 | |
| EU-A1680 | 0.026 | | 0.114 | |
| EU-A1681 | 0.009 | | 0.132 | |
| EU-A1682 | 0.21 | | 1.263 | |
| EU-A1710 | 0.026 | | 0.065 | |
| EU-A1711 | 0.009 | | 0.026 | |
| EU-A1712 | 0.037 | | 0.175 | |

-continued

| Compound Number | EC$_{50}$ cAMP GLP-1 R (nM) | EC$_{50}$ Arrestin GLP-1 R (nM) | EC$_{50}$ cAMP Glucagon R (nM) | EC$_{50}$ Arrestin Glucagon R (nM) |
|---|---|---|---|---|
| EU-A1713 | 0.308 | | 2.509 | |
| EU-A1716 | 0.013 | | 0.032 | |
| EU-A1717 | 0.011 | | 0.035 | |
| EU-A1718 | 0.043 | | 0.097 | |
| EU-A1719 | 0.095 | | 0.746 | |
| EU-A1722 | 0.006 | | 0.012 | |
| EU-A1723 | 0.028 | | 0.062 | |
| EU-A1729 | 0.006 | | 0.558 | |
| EU-A1730 | 0.008 | | 1.172 | |
| EU-A1734 | 0.006 | | 0.387 | |
| EU-A1735 | 0.008 | | 0.931 | |
| EU-A1739 | 0.056 | | 2.223 | |
| EU-A1740 | 0.077 | | 3.825 | |
| EU-A1745 | 1.017 | | 10. | |
| EU-A1784 | 0.048 | | 1.907 | |
| EU-A1785 | 0.239 | | 5.145 | |
| EU-A1787 | 0.246 | | 10.0 | |
| EU-A1788 | 0.232 | | 10.0 | |
| EU-A1841 | 0.316 | | 0.475 | |
| EU-A1842 | 1.209 | | 2.109 | |
| EU-A1847 | 0.032 | | 1.95 | |
| EU-A1848 | 0.060 | | 3.064 | |

Example 8. Glucose-Lowering Activity of Peptide Products in Db/Db Mice

The 60 female db/db B6BKS (D) Leprdb/J (strain 000697) mice for this study were about 8-9 weeks old at arrival (Jackson Laboratory, Bar Harbor, Me.). The mice were randomized by weight, and two treatment groups of 8 female mice each were administered the test compound EU-A994, EU-A995 or EU-A1026 at a dose level of 100 or 300 nmoles/kg. One group of 8 female mice served as the vehicle control and received the vehicle, 0.2% BSA in saline, pH 7.4. One additional group of 8 female mice received the positive-control compound, liraglutide, at a dose level of 50 nmoles/kg. The test compounds, vehicle and positive-control compound were subcutaneously injected at a dose volume of 6 mL/kg on day 1 at about 0, 7 and 24 hours.

Clinical observations were conducted at receipt, prior to randomization, and daily from days 1 to 5. Body weights were measured and recorded at receipt, prior to randomization, and daily from days 1 to 5. Food consumption was measured and recorded daily from days 1 to 5. Blood samples for glucose analysis were collected pre-study (day −3) and at 0, 1, 2, 4, 8, 10, 24, 48, 72 and 96 hours following the first dose on day 1. At study termination all animals were euthanized, and the carcasses were discarded without further evaluation.

Significant body weight changes versus vehicle were noted for liraglutide and high-dose EU-A994 and high-dose EU-A1026 on days 2 and 3 and for low-dose EU-A1026 on days 3 and 4. Regarding food consumption, liraglutide-treated animals were significantly different from vehicle on days 1 and 2, and high-dose EU-A994 at day 1, low-dose EU-A995 at days 1 and 2, high-dose EU-A994 at day 1, and low- and high-dose EU-A1026 at day 2 were significantly different from liraglutide. Glucose levels for liraglutide at 10 hr and for high-dose EU-A994 at 10 and 24 hr were significantly different from vehicle. In a similar manner, other peptide products were tested for their effects on blood glucose, body weight and food consumption.

| Compound | Dose (nmole/kg) | db/db Mice-Mean Blood Glucose (mg/dL) | | | |
|---|---|---|---|---|---|
| | | 0 hr | 10 hr | 24 hr | 48 hr |
| liraglutide | 50 | 595 | 265 | 347 | 377 |
| EU-A994 | 300 | 554 | 242 | 209 | 385 |
| EU-A995 | 300 | 503 | 471 | 493 | 527 |
| EU-A1026 | 300 | 531 | 399 | 438 | 505 |
| liraglutide | 50 | 528 | 286 | 404 | 477 |
| EU-A993 | 250 | 503 | 305 | 324 | 426 |
| EU-A995 | 250 | 539 | 584 | 548 | 546 |
| EU-A1023 | 50 | 507 | 310 | 355 | 375 |
| EU-A1023 | 250 | 508 | 264 | 194 | 375 |
| liraglutide | 50 | 442 | 174 | 244 | 439 |
| EU-A992 | 250 | 405 | 104 | 112 | 130 |
| EU-A1167 | 250 | 379 | 171 | 117 | 113 |
| EU-A1168 | 250 | 380 | 133 | 169 | 164 |

Figure 9:
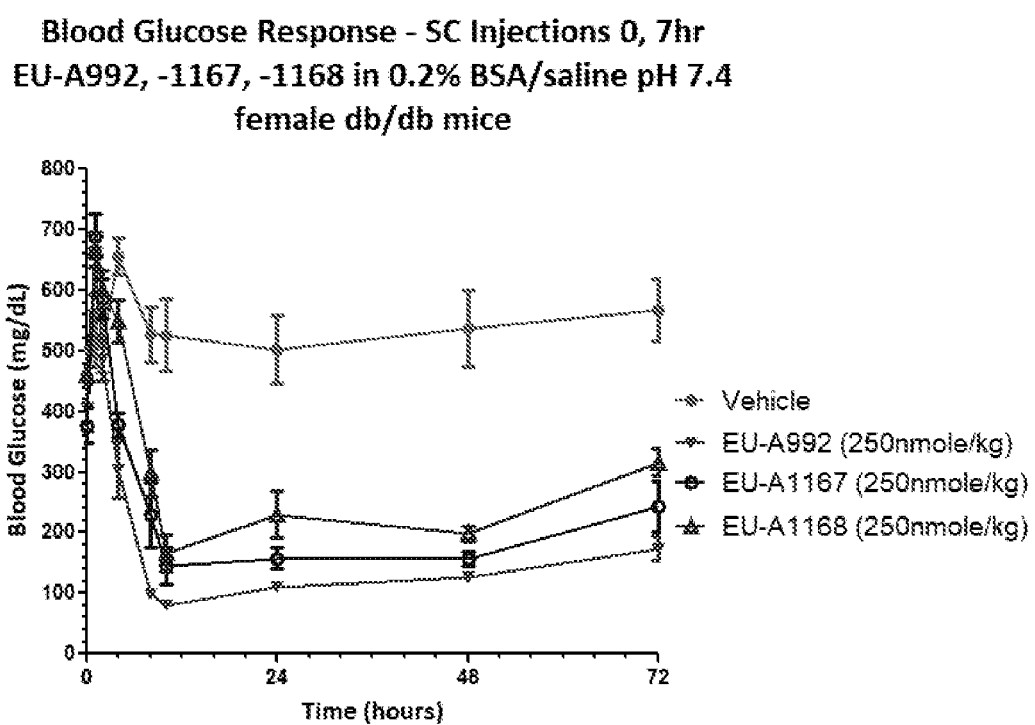
FIG. 9 shows the blood glucose response of db/db mice after subcutaneous injections of EU-A992, EU-A1167 and EU-A1168 (each at 250 nmol/kg) at t=0 and 7 hr.

FIG. 9 shows that EU-A992 (250 nmol/kg), EU-A1167 (250 nmol/kg) and EU-A1168 (250 nmol/kg) subcutaneously injected at t=0 and 7 hr reduced the mice's elevated blood glucose level to the normal range for around 72 hr in the diabetic db/db mouse model.

Example 9. Activity of Peptide Products in DIO Mice

Fifty diet-induced obese (DIO) C57BL/6J male mice (JAX Labs) were received at 6 wks of age. The mice were ear notched for identification and housed individually in positively ventilated polycarbonate cages with HEPA-filtered air at a density of 5 mice per cage. The animal room was lit entirely with artificial fluorescent lighting, with a controlled 12 hr light/dark cycle. The normal temperature and relative humidity ranges in the animal rooms were 22±4° C. and 50±15%, respectively. Filtered tap water, acidified to a pH of 2.8-3.1, and a high-fat diet (Research Diets D12492, 60 kcal %) were provided ad libitum.

Following a 2 week acclimation, the 50 mice were randomized into groups (n=10): Group 1: treated with vehicle; Group 2: low-dose EU-A994; Group 3: high-dose EU-A594; Group 4: low-dose EU-A1024; and Group 5: high-dose EU-A1024. Mice were dosed subcutaneously on days 1 (at 0 and 7 hr), 3, 6, 9, 12, 15, 18, 21 and 24. Body weight and cage-side observations were recorded daily. Food and water intake was recorded weekly. Mice underwent NMR measurements for determination of whole-body fat and lean composition on days 1 (pre-dose) and 26. On day 26, mice were fasted overnight for an oral glucose tolerance test. Next day, the first blood sample was collected via tail nick (t=0). Mice were then administered a bolus of 1.0 g/kg glucose. Blood samples were obtained via tail nick at 0, 15, 30, 60, 90 and 120 min after glucose dosing, and plasma glucose was immediately determined using a glucometer.

Figure 10:
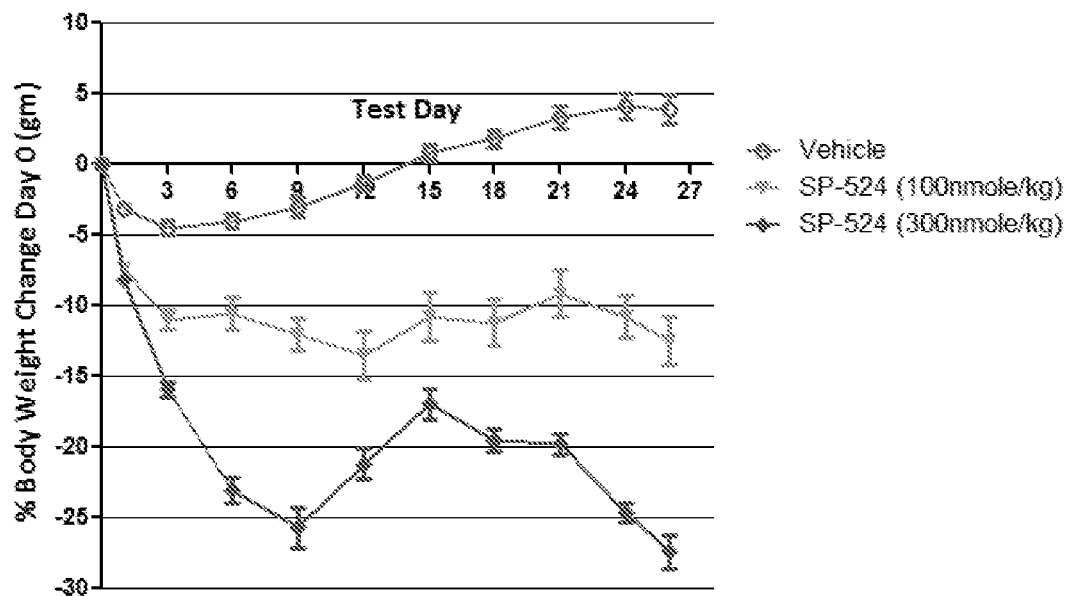
FIG. 10 shows the weight loss in diet-induced obese (DIO) mice after subcutaneous injection of the peptide product EU-A1024 at two different doses on days 1 (at T=0 and 7 hr), 3, 6, 9, 12, 15, 18, 21 and 24.
Figure 11:
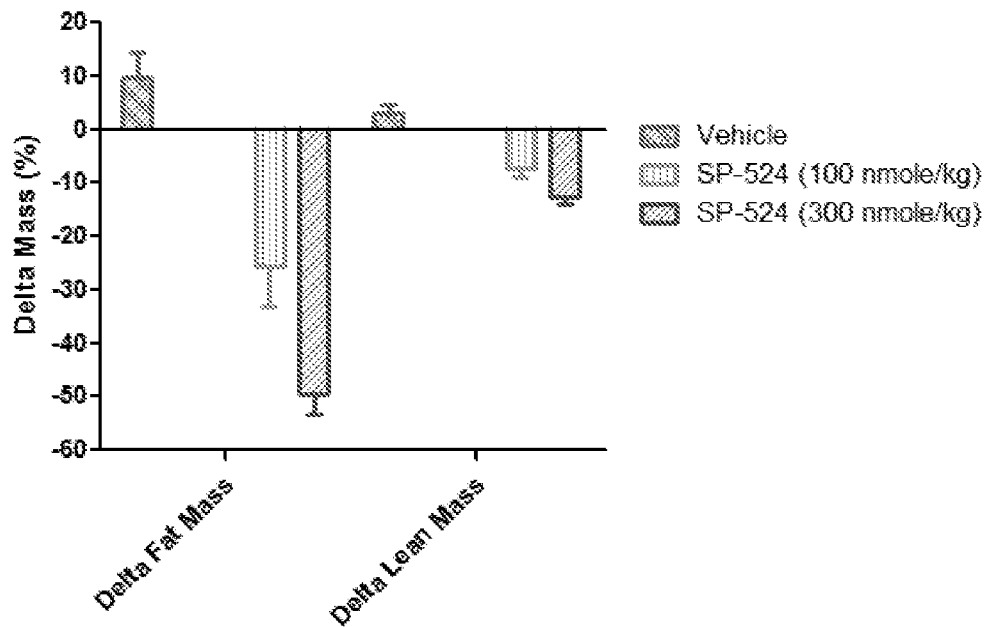
FIG. 11 shows the change in whole-body fat tissue mass and lean tissue mass in the DIO mice treated so as measured by NMR on days 1 (pre-dose) and 26.

Mice were sacrificed on day 28. Terminal blood was processed to serum/plasma, and aliquots were sent for analysis of glucose, insulin and lipid profile. Body composition was determined by NMR. EU-A1024 reduced glucose excursion in the oral glucose tolerance test (OGTT), reduced basal insulin secretion but increased glucose-dependent insulin secretion, reduced weight gain (FIG. 10), and reduced fat mass with little effect on lean mass (FIG. 11).

Example 10. Efficacy of SP-1373 in a Mouse Model of NASH

In a biopsy-proven DIO-NASH mouse model, SP-1373, a peptide-surfactant conjugate and a dual GLP-1 receptor/ glucagon receptor agonist, demonstrated superior outcome measures in liver histopathology and metabolic parameters compared to semaglutide (a GLP-1 agonist) and elafibranor (a PPAR-α/δ agonist). Non-alcoholic steatohepatitis (NASH) was induced in male C57BL/6JRj mice (about 20 g, 5 weeks old at arrival, 37 weeks old at study start) by feeding them an AMLN diet comprising 40% fat (18% trans-fat), 2% cholesterol and 40% carbohydrates (20% fructose) for 32 weeks prior to study start and during the study period.

All mice entering the study were stratified based on liver pre-biopsy at week −3. Only mice with a fibrosis score ≥1 and a steatosis score ≥2 were included in the study. The stratified mice were randomized into treatment groups based on liver collagen type 1 alpha 1 (col1a1) quantification at week −3. The groups of the NASH study were: 1) vehicle (0.05% Tween 80, 50 mM Nα$_2$HPO$_4$, pH 8) given subcutaneously (SC) once a day (QD) for 12 weeks (n=12); 2) low dose (5 nmole/kg) of SP-1373 given SC QD for 12 weeks (n=11); 3) high dose (10 nmole/kg) of SP-1373 given SC QD for 12 weeks (n=11); 4) 78 mole/kg of elafibranor given orally (PO) QD for 12 weeks (n=12); and 5) 10 nmole/kg of semaglutide given SC QD for 12 weeks (n=12).

Body weight was measured daily for the entire study period. Food intake was measured daily for the first 14 days, and then weekly until study end. EchoMRI whole-body scanning was performed in week 11. At study end were measured plasma levels of alanine transaminase (ALT), aspartate transaminase (AST), γ-glutamyltransferase (GGT), triglycerides (TG) and total cholesterol (TC), liver levels of TG, TC, col1α1 and galectin-3, the expression levels of a wide variety of mRNAs in the liver, and the liver weight, and were performed liver biopsy/necropsy to assess steatosis, inflammation, ballooning and fibrosis of the liver.

For blood and plasma assays, blood samples were collected in heparinized tubes and plasma was separated and stored at −80° C. until analysis. ALT, AST, GGT, TG and TC levels were measured using commercial kits (Roche Diagnostics, Germany) and the Cobas™ C-501 autoanalyzer according to the manufacturer's instructions.

For liver tissue assays, the triglycerides and cholesterol content in the liver was measured using the Triglyceride and Cholesterol reagents (Cat. No. 22-045-795 and Cat. No. 22-045-780, respectively, Roche Diagnostics, Germany) and the Cobas™ C-501 autoanalyzer. Homogenized liver tissue was heated to 80-100° C. twice and centrifuged in a microcentrifuge, and the triglycerides and cholesterol content in the resulting supernatant was measured.

The body composition of the mice was assessed by an EchoMRI 3-1 body composition analyzer (EchoMRI, U.S.). Unanesthetised mice were placed in a plastic tube inside the MRI scanner for about 80 seconds. The body composition was expressed as fat tissue mass, fat-free tissue mass (lean tissue mass) and water.

For liver biopsy, mice were anesthetized by inhalation of isoflurane (2-3%). A small abdominal incision was made in the midline, and the left lateral lobe of the liver was exposed. A cone-shaped wedge of liver tissue (about 50 mg) was excised from the distal portion of the lobe and fixated in 10% neutral-buffered formalin (4% formaldehyde) for histology. The cut surface of the liver was instantly electro-coagulated using bipolar coagulation (ERBE VIO 100 electrosurgical unit). After pre-biopsy, the liver was returned to the abdominal cavity, the abdominal wall was sutured, and the skin was closed with staples. For post-operative recovery, the mice were administered carprofen (5 mg/kg) subcutaneously on the day of operation and on days 1 and 2 post-operation.

For histological staining, in brief, slides with paraffin-embedded sections were de-paraffinated in xylene and then rehydrated in a series of graded ethanol. For hematoxylin and eosin (H&E) staining, the slides were incubated in Mayer's Hematoxylin (Dako), washed in tap water, stained in Eosin Y solution (Sigma-Aldrich), hydrated, mounted with Pertex and then allowed to dry before scanning. For picrosirius red (PSR) staining, the slides were incubated in Weigert's iron hematoxylin (Sigma-Aldrich), washed in tap water, stained in picrosirius red (Sigma-Aldrich) and then washed twice in acidified water. Excess water was removed by shaking the slides, and the slides were dehydrated in three changes of 99% ethanol, cleared in xylene, mounted with Pertex and then allowed to dry before scanning.

For collagen type 1 alpha 1 (col1a1) and galectin-3 (GAL3) immunohistochemical (IHC) staining, after antigen retrieval and blocking of endogenous peroxidase activity, slides were incubated with the primary antibody (Cat. No. 1310-01 from Southern Biotech for col1α1, or Cat. No. 125402 from Biolegend for galectin-3). The anti-col1a1 primary antibody was detected using a polymeric horseradish peroxidase (HRP)-linker antibody conjugate, and the anti-GAL3 primary antibody was detected using a linker secondary antibody followed by amplification using a polymeric HRP-linker antibody conjugate. Next, the primary antibody was visualized with 3,3'-diaminobenzidine (DAB) as the chromogen. Finally, sections were counterstained in hematoxylin and cover-slipped.

To assess steatosis, inflammation, ballooning and fibrosis of the liver, liver samples were fixed in formalin and embedded in paraffin, and sections were stained with hematoxylin and eosin or picrosirius red. Samples were scored for steatosis, inflammation, ballooning and fibrosis as summarized in Table 9.

Figures 12A, 12B:
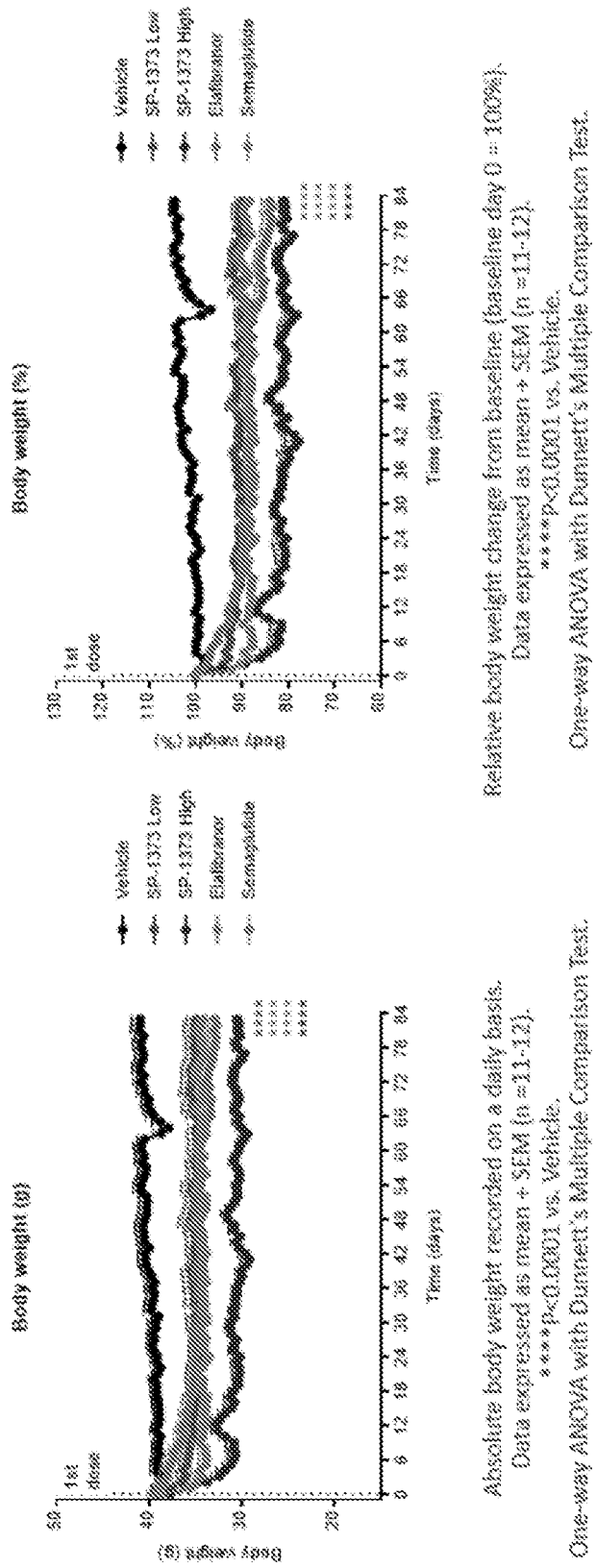
FIGS. 12A-12B show the effects of test compounds on body weight in a diet-induced obese (DIO) mouse model of NASH.
Figure 13B:
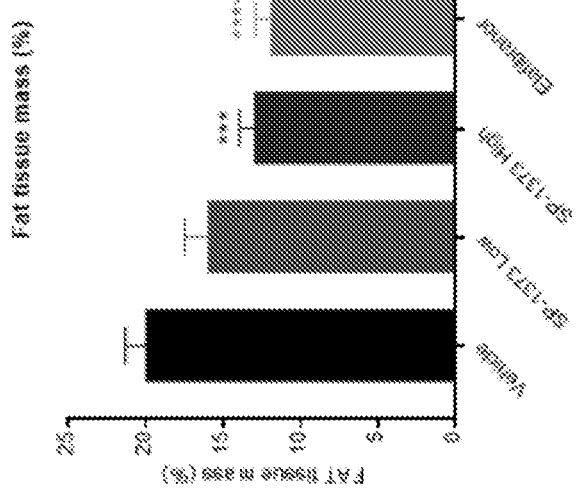
FIGS. 13A-13B show the effects of test compounds on whole-body fat tissue mass in DIO-NASH mice.
Figure 13A:
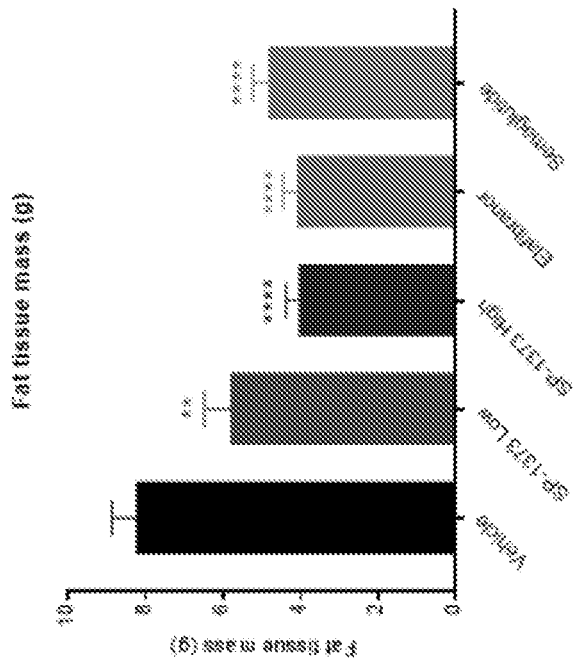
Figure 14B:
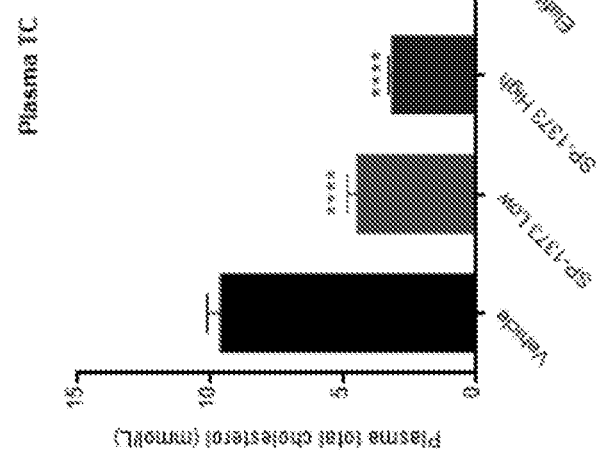
FIGS. 14A-14B show the effects of test compounds on plasma triglycerides (TG) and total cholesterol (TC) levels in DIO-NASH mice.
Figure 14A:
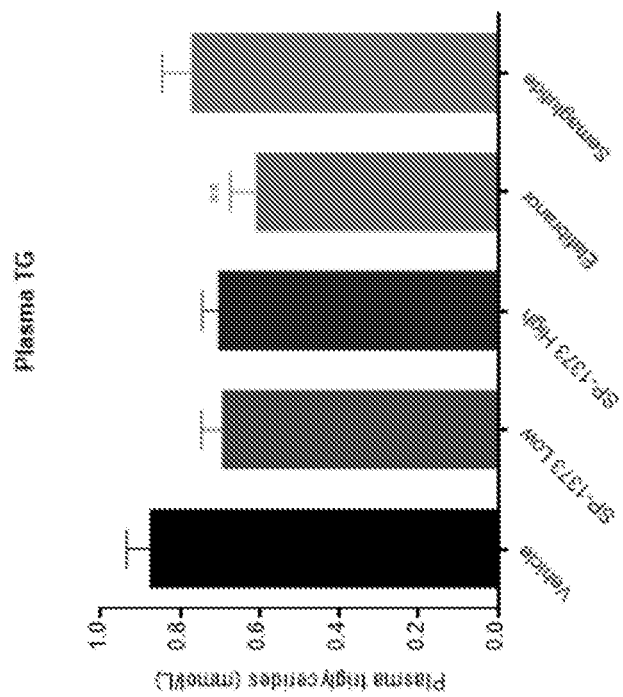
Figure 15A:
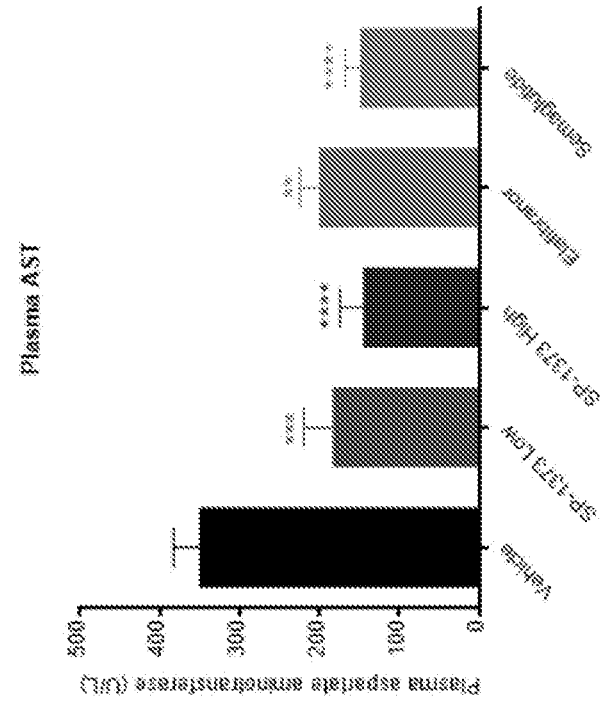
FIGS. 15A-15B show the effects of test compounds on plasma alanine transaminase (ALT) and aspartate transaminase (AST) levels in DIO-NASH mice.
Figure 15B:
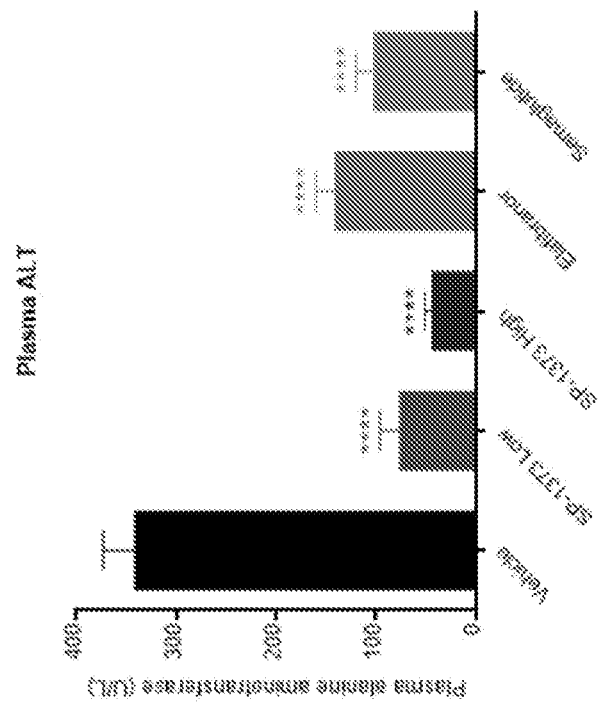

SP-1373 (high dose) significantly reduced body weight of the obese mice to the low normal range, while semaglutide and elafibranor caused less body weight decrease (FIGS. 12A and 12B [high-dose SP-1373 was inadvertently administered to the vehicle group on day 62]). SP-1373 caused a marked decrease in whole-body fat tissue mass (FIGS. 13A and 13B), with minimal effect on whole-body lean tissue mass. Plasma levels of total cholesterol (TC, FIG. 14B), alanine transaminase (ALT, FIG. 15A), and aspartate transaminase (AST, FIG. 15B) were also markedly reduced in SP-1373-treated animals. Plasma ALT and AST levels and the AST/ALT ratio are clinical biomarkers for liver health. The beneficial effects of SP-1373 demonstrate the advantages of dual GLP-1 receptor/glucagon receptor agonism. GLP-1 receptor agonism stimulates insulin production and blood glucose-dependent insulin secretion, lowers blood glucose levels, suppresses appetite and causes weight loss. Glucagon receptor agonism has anti-hyperlipidemic and satiating effects, stimulates fat burning and energy expenditure, and reduces body weight.

Figure 16:
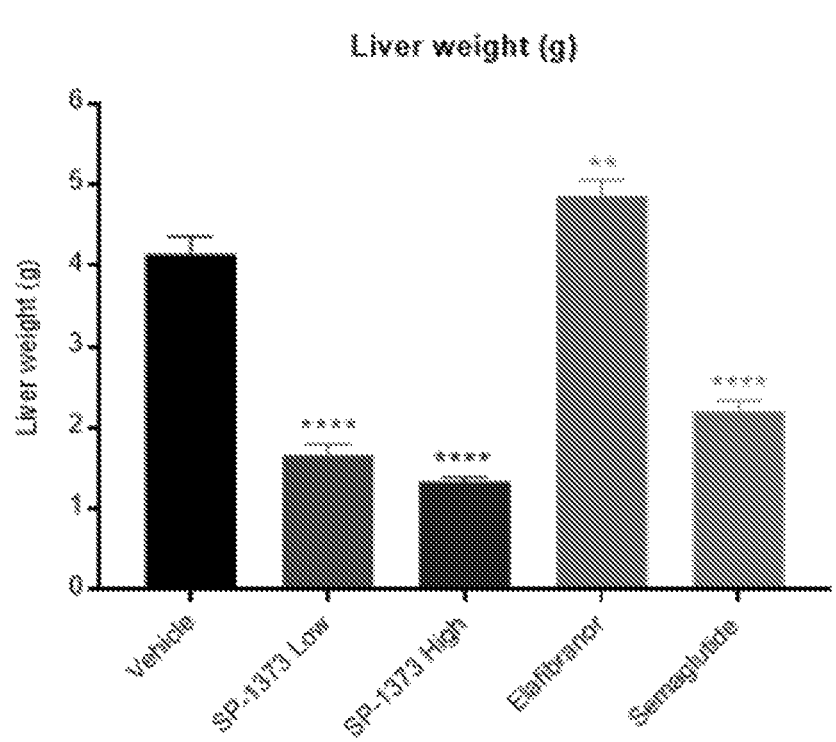
FIG. 16 shows the effects of test compounds on liver weight in DIO-NASH mice.
Figure 18A:
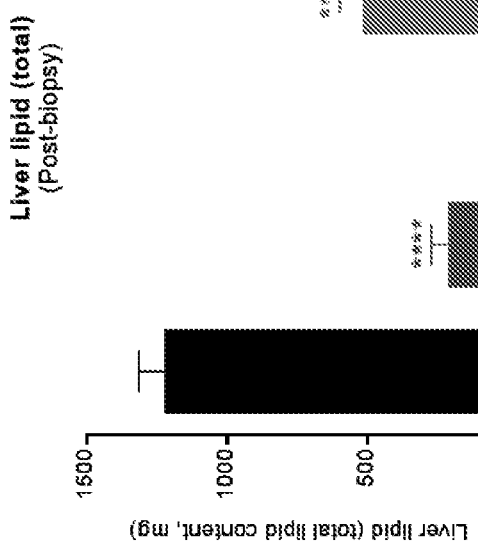
FIGS. 18A-18B show the effects of test compounds on post-biopsy liver steatosis in terms of % area affected and total liver lipid content as determined by histological quantitative measurement in DIO-NASH mice.
Figure 18B:
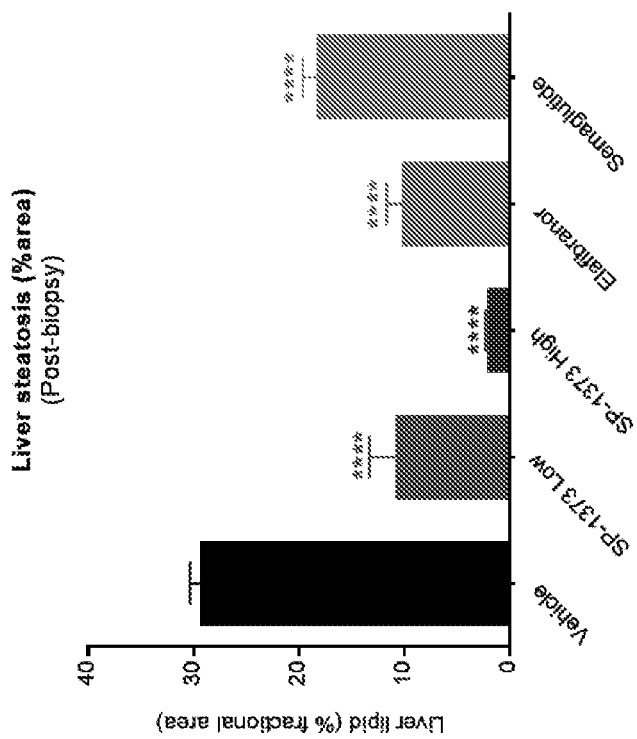
Figures 19A, 19B:
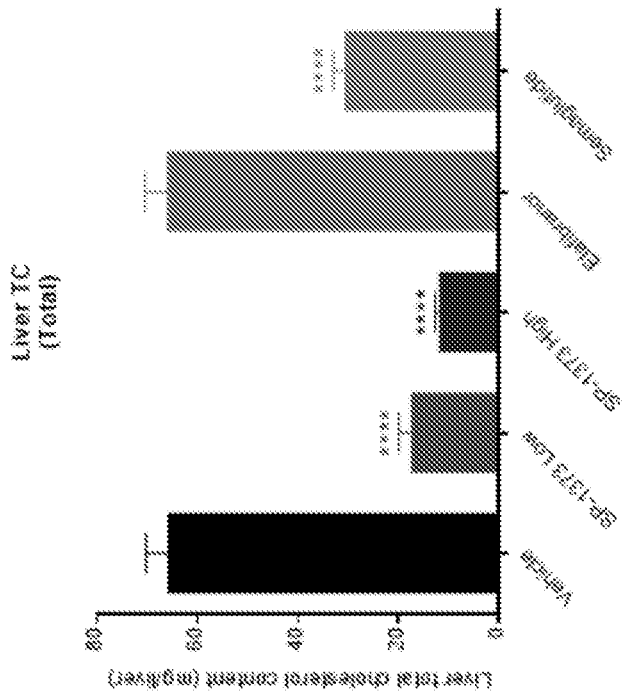
FIGS. 19A-19B show the effects of test compounds on liver triglycerides (TG) and total cholesterol (TC) levels in DIO-NASH mice.
Figure 20:
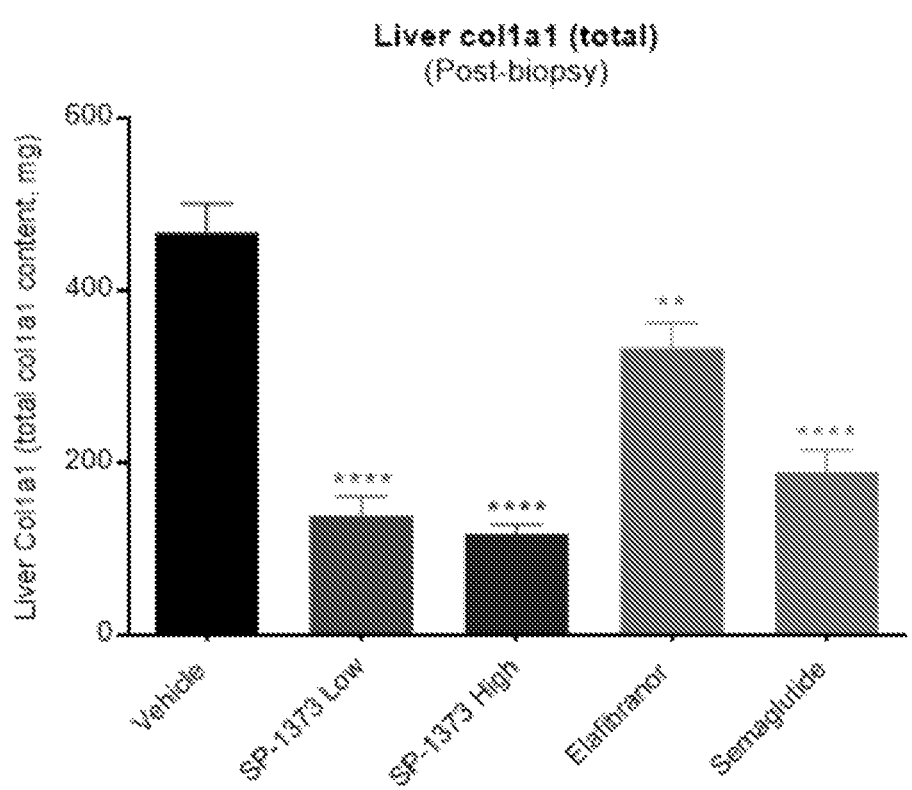
FIG. 20 shows the effects of test compounds on total liver collagen type 1 alpha 1 (col1a1) content as measured immunohistochemically in DIO-NASH mice.
Figure 21:
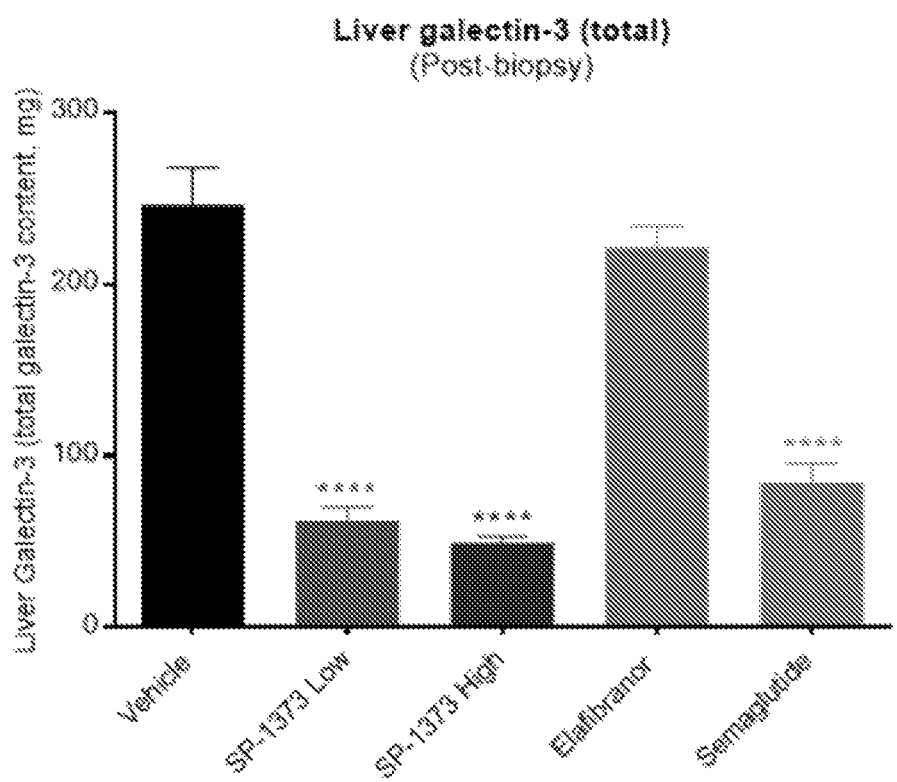
FIG. 21 shows the effects of test compounds on total liver galectin-3 content as measured immunohistochemically in DIO-NASH mice.
Figures 27A, 27B, 27C, 27D, 27E, 27F:
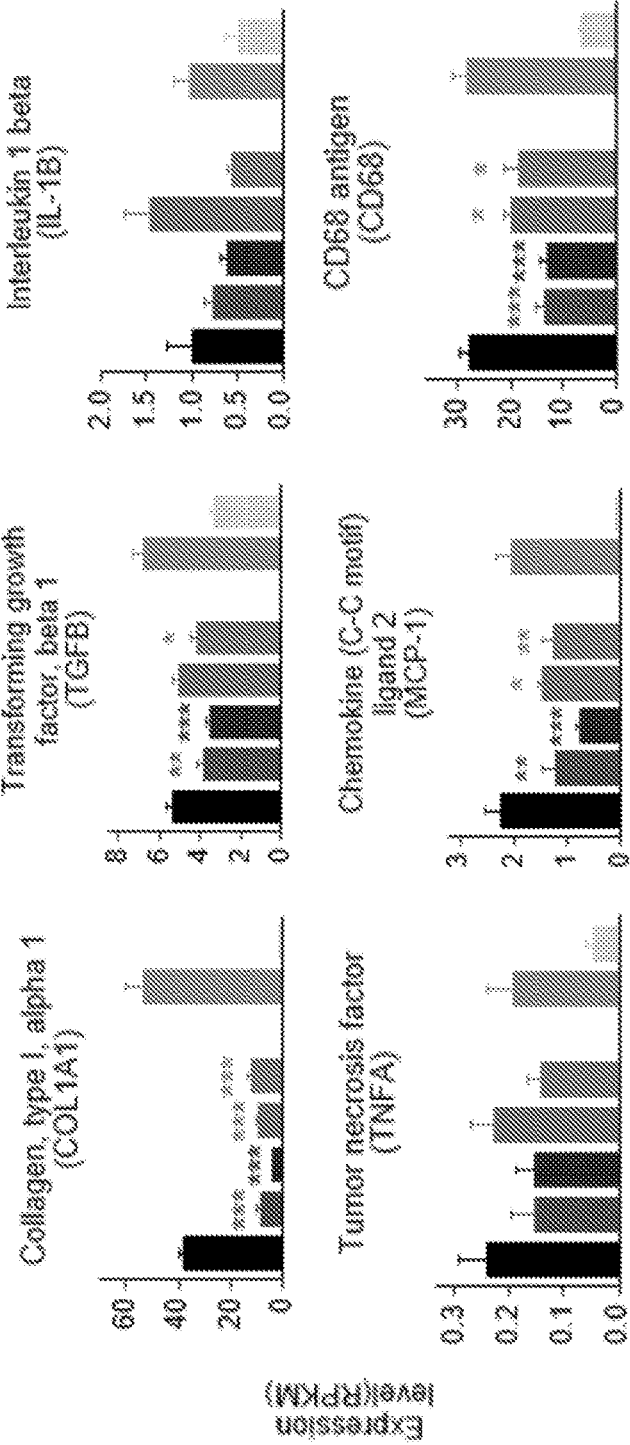
FIG. 27A-27F show the effects of test compounds in DIO-NASH mice on hepatic expression of mRNAs involved in fibrosis, inflammation, and monocyte recruitment and differentiation.
Figures 30A, 30B, 30C, 30D, 30E, 30F:
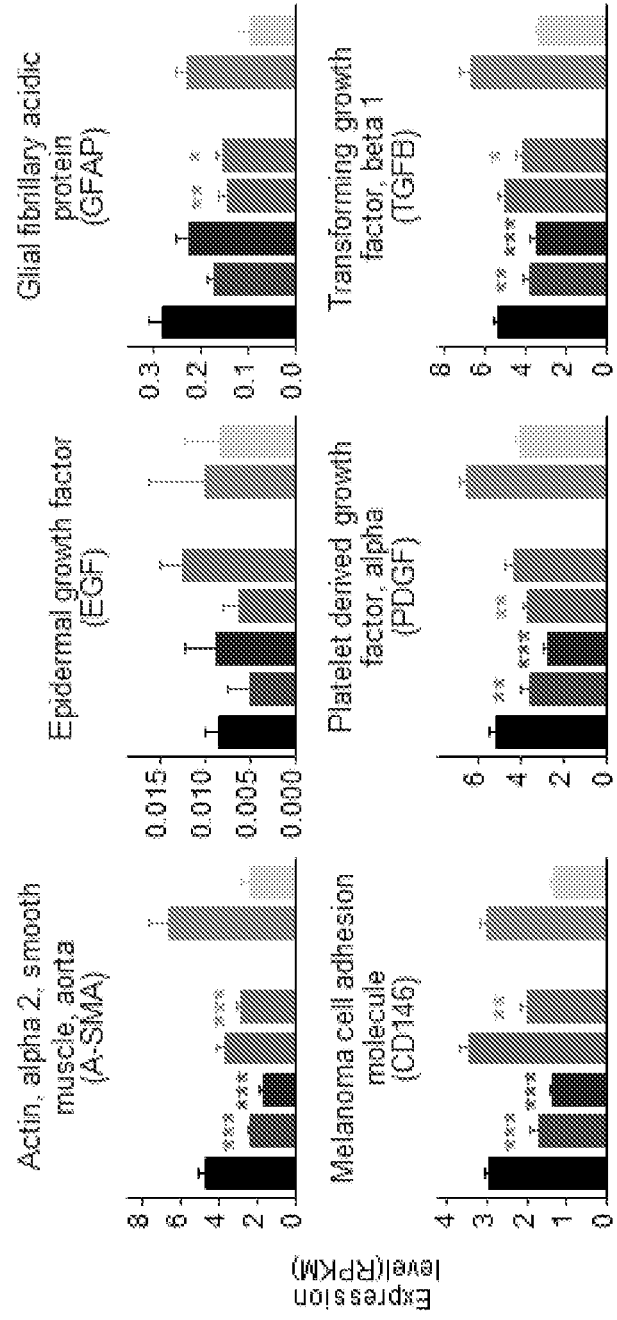
FIGS. 30A-30F show the effects of test compounds in DIO-NASH mice on hepatic expression of mRNAs involved in hepatic stellate cell activation and myofibroblast proliferation.

SP-1373 caused a large decrease in liver weight, more so than semaglutide, whereas elafibranor actually increased liver weight (FIG. 16). Histology of the liver using hematoxylin and eosin stain revealed a nearly complete absence of liver steatosis in the animals treated with high-dose SP-1373 (FIG. 17C [the large white eliptical structure is a vein]), in contrast to the semaglutide-treated animals (FIG. 17E), which showed a moderate decrease in hepatosteatosis. FIGS. 18A and 18B show the post-biopsy liver steatosis in terms of % area affected and total liver lipid content in the different groups of animals as determined by histological quantitative assessment, confirming a nearly complete absence of liver steatosis in the animals treated with high-dose SP-1373. SP-1373 greatly reduced liver triglycerides (TG) and total cholesterol (TC) levels, more so than semaglutide, whereas elafibranor had little or no effect on liver TG and TC levels (FIGS. 19A and 19B). SP-1373 also greatly reduced total liver collagen type 1 alpha 1 staining with an anti-col1a1 antibody (a measure of liver fibrosis), more so than semaglutide, while elafibranor had a modest effect (FIG. 20). Likewise, SP-1373 greatly reduced total liver galectin-3 staining with an anti-GAL3 antibody (a biomarker for liver inflammation and fibrosis), more so than semaglutide, whereas elafibranor had essentially no effect (FIG. 21).

High-dose SP-1373 greatly reduced or eliminated liver steatosis in all of the treated animals (FIG. 22C). In FIGS. 22A-22E, for each animal the change from pre-study to post-study biopsy is indicated by a line, and liver steatosis is scored 0-3 in terms of surface area with steatosis. The majority of treated animals exhibited less liver inflammation (FIGS. 23A-23E). In FIGS. 23A-23E, for each animal the change from pre-study to post-study biopsy is indicated by a line, and liver inflammation is scored 0-3 in severity. Nearly all of the animals that initially exhibited hepatocyte ballooning showed no ballooning after treatment with SP-1373, elafibranor or semaglutide (FIGS. 24A-24E). In FIGS. 24A-24E, for each animal the change from pre-study to post-study biopsy is indicated by a line, and hepatocyte ballooning is scored 0-2 in severity. The liver steatosis, inflammation and ballooning scores are explained in Table 9.

NAS (non-alcoholic fatty liver disease [NAFLD] activity score) score, a clinical measure of NASH activity, improved in most of the treated animals and was reduced to the greatest extent by high-dose SP-1373 (FIGS. 25A-25E). In FIGS. 25A-25E, for each animal the change from pre-study to post-study biopsy is indicated by a line. The NAS score is the sum of the scores for liver steatosis (0-3), inflammation (0-3) and ballooning (0-2), with a maximum score of 8. A human with a NAS score of 5 or greater is diagnosed as having NASH, while a human with a NAS score of 3 or less is diagnosed as not having NASH. If translated to the mouse model of NASH, high-dose SP-1373 reversed NASH in all of the treated animals (FIG. 25C).

SP-1373 and elafibranor reduced liver fibrosis in the majority of animals (FIGS. 26B-26D). Liver fibrosis was assessed using picrosirius red, which stains types 1 and 3 collagen. In FIGS. 26A-26E, for each animal the change from pre-study to post-study biopsy is indicated by a line, and liver fibrosis is scored 0-4, as explained in Table 9.

TABLE 9

Liver steatosis, inflammation, ballooning and fibrosis scores

| Feature | Score | Degree |
|---|---|---|
| Liver steatosis | 0 | <5% surface area affected |
|  | 1 | 5-33% |
|  | 2 | >33-66% |
|  | 3 | >66% |
| Lobular inflammation[1] | 0 | No foci |
|  | 1 | <2 foci/200× magnification |
|  | 2 | 2-4 foci/200× |
|  | 3 | >4 foci/200× |
| Ballooning degeneration[2] | 0 | None |
|  | 1 | Few balloon hepatocytes |
|  | 2 | Many balloon cells/prominent ballooning |

TABLE 9-continued

Liver steatosis, inflammation, ballooning and fibrosis scores

| Feature | Score | Degree |
|---|---|---|
| Liver fibrosis | 0 | None |
|  | 1 | Perisinusoidal or periportal |
|  | 2 | Perisinusoidal and portal/periportal |
|  | 3 | Bridging fibrosis |
|  | 4 | Cirrhosis |

[1]Lobular inflammation was evaluated by counting the number of inflammatory foci per field using 200× manification (minimum of 5 fields per animal). A focus was defined as a cluster, not a row, of >3 inflammatory cells. Acidophil bodies were not included in the assessment.
[2]Ballooning degeneration was degenerated hepatocytes with a cleared cytoplasm, enlargement, swelling, rounding and reticulated cytoplasm.

SP-1373 reduced the expression of NASH-related mRNAs in the liver, including mRNAs encoding proteins involved in fibrosis {e.g., collagen type 1 alpha 1 (col1a1), transforming growth factor-β1 (TGFβ1) and galectin-3 (GAL3, aka MAC2)}, inflammation {e.g., interleukin-1α (IL-1α), IL-10, tumor necrosis factor-α (TNF-α), GAL3, CD14, toll-like receptor 4 (TLR4), p38 mitogen-activated protein (MAP) kinase 11 and NF-κB}, monocyte recruitment {e.g., chemokine (C—C motif) ligand 5 (CCL5, aka RANTES), monocyte chemoattractant protein 1 (MCP1, aka CCL2), chemokine (C—C motif) receptor 1 (CCR1) and CCR2}, and monocyte differentiation into, e.g., macrophages {e.g., GAL3, EGF-like module-containing mucin-like hormone receptor-like 1 (EMR1, aka F4/80), CD14, CD68 and CD86}(FIGS. 27A-27F and FIGS. 28A-28F). More specifically with respect to fibrosis, SP-1373 reduced hepatic expression of mRNAs encoding proteins involved in fibrotic fiber formation (FIGS. 29A-29I) and activation of hepatic stellate cells (the major cell type involved in liver fibrosis) and myofibroblast proliferation (FIGS. 30A-30F). Furthermore, SP-1373 reduced hepatic expression of mRNAs encoding proteins involved in pyroptosis, a highly inflammatory form of programmed cell death (FIGS. 31A-31F). For the FIGS. referred to in this paragraph, the expression level of a particular mRNA is the average plus SEM, and *$P<0.05$, $P<0.01$ and *$P<0.001$ compared to vehicle after correction for gene-wise multiple testing. SP-1373 also reduced hepatic expression of mRNAs encoding proteins involved in lipid synthesis (e.g., fatty acid synthase [FAS], stearoyl-CoA desaturase-1 [SCD1] and 3-hydroxy-3-methylglutaryl-CoA synthase 1 [HMGCS1]) and lipid uptake (e.g., CD36). Moreover, SP-1373 increased hepatic expression of farnesoid X receptor (FXR) mRNA. In addition, SP-1373 modulated the expression of genes encoding proteins involved in, e.g., insulin signaling and glucose homeostasis.

In summary, SP-1373 reversed liver steatosis, reduced liver inflammation and fibrosis, and markedly improved NAS score, while also addressing metabolic and glucoregulatory deficits, in a well-recognized translational mouse model of NASH. SP-1373 is a potent, balanced and full agonist at the GLP-1 and glucagon receptors and has anti-diabetic and anti-obesity effects. Compared to the GLP-1 agonist semaglutide, SP-1373 has a stronger anti-hyperglycemic effect, reduces body weight, fat tissue mass and food intake to a greater extent, and has a longer duration of action. In the DIO-NASH mouse model, compared to treatment with semaglutide or elafibranor (a dual PPAR-α/δ agonist), treatment with SP-1373 resulted in greater reduction in body weight, plasma total cholesterol (TC) and alanine transaminase (ALT) levels, NAS score, hepatosteatosis, liver triglycerides (TG) and TC levels, liver weight, liver collagen type I alpha 1 content (a measure of liver fibrosis), and liver galectin-3 content (a measure of liver inflammation and fibrosis). Therefore, SP-1373 is useful for treating, e.g., insulin resistance, diabetes (including types 1 and 2), hyperlipidemia, obesity, metabolic syndrome and cardiovascular diseases, and conditions associated therewith, such as NAFLD (including NASH).

While various embodiments of the present disclosure have been described, such embodiments are provided by way of illustration and example only. Numerous variations thereof and modifications thereto will be apparent to those skilled in the art and are encompassed by the present disclosure. It is understood that various alternatives to the embodiments of the disclosure can be employed in practicing the disclosure and are encompassed by the disclosure.

Specific Embodiments

Specific Embodiment 1: A peptide product or a pharmaceutically acceptable salt thereof for use in the treatment of polycystic ovary syndrome, a kidney disorder or a liver disorder, wherein the peptide product has Formula I-A and comprises a surfactant X covalently attached to a peptide, the peptide comprising a linker amino acid U and at least one other amino acid:

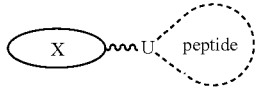

Formula I-A wherein the surfactant X is a moiety of Formula I:

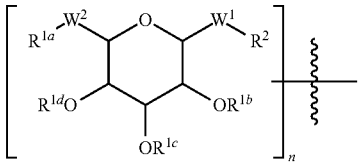

Formula I wherein:
$R^{1a}$ at each occurrence independently is a bond, H, a protecting group, a saccharide, an unsubstituted or substituted $C_1$-$C_{30}$ alkyl group, an unsubstituted or substituted aralkyl (-alkylaryl) group, an unsubstituted or substituted alkyloxyaryl group, or a steroid nucleus-containing group;
$R^{1b}$, $R^{1c}$ and $R^{1d}$ at each occurrence independently are a bond, H, a protecting group, a saccharide, an unsubstituted or substituted $C_1$-$C_{30}$ alkyl group, an unsubstituted or substituted aralkyl group, an unsubstituted or substituted alkyloxyaryl group, or a steroid nucleus-containing group;
$R^2$ at each occurrence independently is a bond, a bond to U, H, an substituted or substituted $C_1$-$C_{30}$ alkyl group, an unsubstituted or substituted aralkyl group, an unsubstituted or substituted alkyloxyaryl group, a steroid nucleus-containing group, —NH—, —S—, —O—NH—, a spacer, -triazolo-, —NH(C=O)—CH$_2$—, or —(CH$_2$)$_m$-maleimide-;
$W^1$ at each occurrence independently is —CH$_2$—, —CH$_2$—O—, —CH$_2$—S—, —CH$_2$—NH—, —(C=O)—, —(C=O)—NH—, —(C=S)—, or —(C=S)—NH—;

$W^2$ at each occurrence independently is —O—, —S—, —NH—, or —CH$_2$—;
at least one occurrence of $R^{1a}$, $R^{1b}$, $R^{1c}$, $R^{1d}$ or $R^2$ is an unsubstituted or substituted $C_1$-$C_{30}$ alkyl, aralkyl, alkyloxyaryl or steroid nucleus-containing group;
m is an integer from 1 to 10; and
n is 1, 2 or 3; and
the peptide has Formula II:

(SEQ. ID. NO. 1108)
aa$_1$-aa$_2$-aa$_3$-aa$_4$-aa$_5$-aa$_6$-aa$_7$-aa$_8$-aa$_9$-aa$_{10}$-aa$_{11}$-aa$_{12}$-aa$_{13}$- aa$_{14}$-aa$_{15}$-aa$_{16}$-aa$_{17}$-aa$_{18}$-aa$_{19}$-aa$_{20}$-aa$_{21}$-aa$_{22}$-aa$_{23}$-aa$_{24}$- aa$_{25}$-aa$_{26}$-aa$_{27}$-aa$_{28}$-aa$_{29}$-aa$_{30}$-aa$_{31}$-aa$_{32}$-aa$_{33}$-aa$_{34}$-aa$_{35}$- aa$_{36}$-aa$_{37}$-Z    Formula II wherein:
Z is —OH, —NHR$^3$ or —N(R$^4$)His, wherein:
  R$^3$ is H, unsubstituted or substituted $C_1$-$C_{12}$ alkyl, or a PEG-containing group of less than 10 Da; and
  R$^4$ is H, $C_2$-$C_{10}$ acyl or —C(=O)-aryl;
aa$_1$ is His, N(R$^3$)His, N(R$^4$)His, or pGlu-His;
aa$_2$ is Ser, D-Ser, Ala, Gly, Pro, MePro, Aib, Ac4c or Ac5c;
aa3 is Gln or Cit;
aa4 is Gly or D-Ala;
aa5 is Thr or Ser;
aa$_6$ is Phe, Trp, 2FPhe, MePhe, 2FMePhe or Nal2;
aa$_7$ is Thr or Ser;
aa$_8$ is Ser or Asp;
aa$_9$ is Asp or Glu;
aa$_{10}$ is Tyr, Leu, Met, Nal2, Bip, Bip2EtMe0, Glu, Lys or U;
aa$_{11}$ is absent or Ser, Asn, Bip or U;
aa$_{12}$ is absent or Lys, Glu, Ser, Arg or U;
aa$_{13}$ is absent or Tyr, Gln, Cit or U;
aa$_{14}$ is absent or Leu, Met, Nle, Glu, Lys or U;
aa$_{15}$ is absent or Asp, Glu or U;
aa$_{16}$ is absent or Ser, Gly, Glu, Ala, Aib, Ac5c, Lys, Arg or U;
aa$_{17}$ is absent or Arg, hArg, Gln, Glu, Cit, Aib, Ac4c, Ac5c, Lys or U;
aa$_{18}$ is absent or Arg, hArg, Ala, Aib, Ac4c, Ac5c or U;
aa$_{19}$ is absent or Ala, Val, Aib, Ac4c, Ac5c or U;
aa$_{20}$ is absent or Gln, Lys, Arg, Cit, Glu, Aib, Ac4c, Ac5c or U;
aa$_{21}$ is absent or Asp, Glu, Leu, Aib, Ac4c, Ac5c or U;
aa$_{22}$ is absent or Phe, Trp, Nal2, Aib, Ac4c, Ac5c or U
aa$_{23}$ is absent or Val, Ile, Aib, Ac4c, Ac5c or U;
aa$_{24}$ is absent or Ala, Gln, Glu, Cit or U;
aa$_{25}$ is absent or Trp, Nal2 or U;
aa$_{26}$ is absent or Leu or U;
aa$_{27}$ is absent or Met, Val, Leu, Nle, Lys or U;
aa$_{28}$ is absent or Asn, Lys, Glu, Gln, Cit or U;
aa$_{29}$ is absent or Thr, Gly, Aib, Ac4c, Ac5c or U;
aa$_{30}$ is absent or Lys, Aib, Ac4c, Ac5c, Arg or U;
aa$_{31}$ is absent or Arg, Aib, Ac4c, Ac5c or U;
aa$_{32}$ is absent or Asn, Aib, Ac4c, Ac5c or U;
aa$_{33}$ is absent or Arg, Aib, Ac4c, Ac5c or U;
aa$_{34}$ is absent or Asn, Aib, Ac4c, Ac5c or U;
aa$_{35}$ is absent or Asn, Aib, Ac4c, Ac5c or U;
aa$_{36}$ is absent or Ala, Ile, Aib, Ac4c, Ac5C or U;
aa$_{37}$ is absent or U;
U is a natural or unnatural amino acid comprising a functional group used for covalent attachment to a surfactant X;

any two of aa$_1$-aa$_{37}$ can optionally be cyclized through their side chains to form a lactam; and provided that one, or at least one, of aa$_{10}$-aa$_{37}$ is a linker amino acid U covalently attached to a surfactant X.

Specific Embodiment 2: The peptide product for use of Specific Embodiment 1, wherein the surfactant X comprises a monosaccharide, such as a suitably functionalized glucose, galactose or mannose (e.g., glucuronic acid, galacturonic acid or mannouronic acid), or a disaccharide, such as a suitably functionalized melibiose, maltose, isomaltose, gentiobiose or lactose (e.g., melibiouronic acid, maltouronic acid, isomaltouronic acid, gentiobiouronic acid or lactouronic acid).

Specific Embodiment 3: The peptide product for use of Specific Embodiment 1 or Specific Embodiment 2, wherein the surfactant X has the structure:

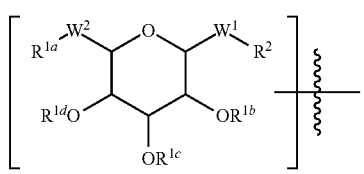

Formula I wherein:
R$^{1a}$ is an unsubstituted or substituted C$_1$-C$_{30}$ alkyl group;
R$^{1b}$, R$^{1c}$, and R$^{1d}$ are H;
R$^2$ is a bond to U;
W$^1$ is —(C=O)—NH—; and
W$^2$ is —O—.

Specific Embodiment 4: The peptide product for use of any one of Specific Embodiments 1 to Specific Embodiment 3, wherein: a) at least one occurrence of R$^{1a}$ is an unsubstituted or substituted C$_8$-C$_{20}$ alkyl group; or b) the surfactant X is a 1-alkyl glycoside, such as 1-eicosyl beta-D-glucuronic acid, 1-octadecyl beta-D-glucuronic acid, 1-hexadecyl beta-D-glucuronic acid, 1-tetradecyl beta-D-glucuronic acid, 1-dodecyl beta-D-glucuronic acid, 1-decyl beta-D-glucuronic acid, 1-octyl beta-D-glucuronic acid, 1-cicosyl beta-D-diglucuronic acid, 1-octadecyl beta-D-diglucuronic acid, 1-hexadecyl beta-D-diglucuronic acid, 1-tetradecyl beta-D-diglucuronic acid, 1-dodecyl beta-D-diglucuronic acid, 1-decyl beta-D-diglucuronic acid, 1-octyl beta-D-diglucuronic acid, 1-eicosyl beta-D-isomaltouronic acid, 1-octadecyl beta-D-isomaltouronic acid, 1-hexadecyl beta-D-isomaltouronic acid, 1-tetradecyl beta-D-isomaltouronic acid, 1-dodecyl beta-D-isomaltouronic acid, 1-decyl beta-D-isomaltouronic acid, 1-octyl beta-D-isomaltouronic acid, 1-eicosyl beta-D-gentiobiouronic acid, 1-octadecyl beta-D-gentiobiouronic acid, 1-hexadecyl beta-D-gentiobiouronic acid, 1-tetradecyl beta-D-gentiobiouronic acid, 1-dodecyl beta-D-gentiobiouronic acid, 1-decyl beta-D-gentiobiouronic acid, 1-octyl beta-D-gentiobiouronic acid, 1-eicosyl beta-D-melibiouronic acid, 1-octadecyl beta-D-melibiouronic acid, 1-hexadecyl beta-D-melibiouronic acid, 1-tetradecyl beta-D-melibiouronic acid, 1-dodecyl beta-D-melibiouronic acid, 1-decyl beta-D-melibiouronic acid, or 1-octyl beta-D-melibiouronic acid, or a functionalized 1-eicosyl beta-D-glucose, 1-octadecyl beta-D-glucose, 1-hexadecyl beta-D-glucose, 1-tetradecyl beta-D-glucose, 1-dodecyl beta-D-glucose, 1-decyl beta-D-glucose, 1-octyl beta-D-glucose, 1-eicosyl beta-D-maltoside, 1-octadecyl beta-D-maltoside, 1-hexadecyl beta-D-maltoside, 1-tetradecyl beta-D-maltoside, 1-dodecyl beta-D-maltoside, 1-decyl beta-D-maltoside, 1-octyl beta-D-maltoside, 1-eicosyl beta-D-melibioside, 1-octadecyl beta-D-melibioside, 1-hexadecyl beta-D-melibioside, 1-tetradecyl beta-D-melibioside, 1-dodecyl beta-D-melibioside, 1-decyl beta-D-melibioside, or 1-octyl beta-D-melibioside, or the corresponding 1-alkyl glycoside with a 6-carboxyl group or 6,6'-dicarboxyl groups, or the corresponding 1-alkyl alpha-anomer.

Specific Embodiment 5: The peptide product for use of any one of Specific Embodiments 1 to Specific Embodiment 4, wherein the peptide comprises amino acid residues aa$_1$-aa$_{27}$, aa$_1$-aa$_{28}$, aa$_1$-aa$_{29}$ or aa$_1$-aa$_{30}$.

Specific Embodiment 6: The peptide product for use of any one of Specific Embodiments 1 to embodiment 5, which has the structure:

(SEQ. ID. NO. 1109)
a) aa$_1$-aa$_2$-aa$_3$-aa$_4$-aa$_5$-aa$_6$-aa$_7$-aa$_8$-aa$_9$-aa$_{10}$-aa$_{11}$-aa$_{12}$-aa$_{13}$-aa$_{14}$-aa$_{15}$-aa$_{16}$-aa$_{17}$-aa$_{18}$-aa$_{19}$-aa$_{20}$-aa$_{21}$-aa$_{22}$-aa$_{23}$-aa$_{24}$-aa$_{25}$-aa$_{26}$-aa$_{27}$-aa$_{28}$-aa$_{29}$-Z Formula III-A wherein:
Z is —OH or —NHR$^3$, wherein R$^3$ is H, unsubstituted or substituted C$_1$-C$_{12}$ alkyl, or a PEG-containing group of less than 10 Da;
aa$_1$ is His, N(R$^3$)His, N(Ac)His, or pGlu-His;
aa$_2$ is Ser, Ala, Gly, MePro, Aib, Ac4c or Ac5c;
aa$_3$ is Gln or Cit;
aa$_4$ is Gly or D-Ala;
aa$_5$ is Thr or Ser;
aa$_6$ is Phe, Trp, 2FPhe, MePhe, 2FMePhe or Nal2;
aa$_7$ is Thr or Scr;
aa$_8$ is Ser or Asp;
aa$_9$ is Asp or Glu;
aa$_{10}$ is Tyr, Leu, Met, Nal2, Bip, Bip2EtMeO, Glu, Lys or U(X);
aa$_{11}$ is absent or Ser, Asn, Bip or U(X);
aa$_{12}$ is absent or Lys, Glu, Ser, Arg or U(X);
aa$_{13}$ is absent or Tyr, Gln, Cit or U(X);
aa$_{14}$ is absent or Leu, Met, Nle, Glu, Lys or U(X);
aa$_{15}$ is absent or Asp, Glu or U(X);
aa$_{16}$ is absent or Ser, Gly, Glu, Ala, Aib, Ac5c, Lys, Arg or U(X);
aa$_{17}$ is absent or Arg, hArg, Gln, Glu, Lys, Cit, Aib, Ac4c, Ac5c or U(X);
aa$_{18}$ is absent or Arg, hArg, Ala, Aib, Ac4c, Ac5c or U(X);
aa$_{19}$ is absent or Ala, Val, Aib, Ac4c, Ac5c or U(X);
aa$_{20}$ is absent or Gln, Lys, Arg, Cit, Glu, Aib, Ac4c, Ac5c or U(X);
aa$_{21}$ is absent or Asp, Glu, Leu, Aib, Ac4c, Ac5c or U(X);
aa$_{22}$ is absent or Phe, Trp, Nal2, Aib, Ac4c, Ac5c or U(X);
aa$_{23}$ is absent or Val, Ile, Aib, Ac4c, Ac5c or U(X);
aa$_{24}$ is absent or Ala, Gln, Glu, Cit or U(X);
aa$_{25}$ is absent or Trp, Nal2 or U(X);
aa$_{26}$ is absent or Leu or U(X);
aa$_{27}$ is absent or Met, Val, Leu, Nle, Lys or U(X);
aa$_{28}$ is absent or Asn, Lys, Glu, Gln or U(X);
aa$_{29}$ is absent or Thr, Gly, Aib, Ac4c, Ac5c or U(X);
any two of aa$_1$-aa$_{29}$ can optionally be cyclized through their side chains to form a lactam; and
provided that one, or at least one, of aa$_{10}$-aa$_{12}$ and aa$_{16}$-aa$_{29}$ is a natural or unnatural amino acid U covalently attached to a surfactant X; or (SEQ. ID. NO. 1111)
b) His$_1$-aa$_2$-aa$_3$-Gly$_4$-Thr$_5$-aa$_6$-Thr$_7$-Ser$_8$-Asp$_9$-aa$_{10}$-aa$_{11}$-aa$_{12}$-aa$_{13}$-aa$_{14}$-aa$_{15}$-aa$_{16}$-aa$_{17}$-aa$_{18}$-aa$_{19}$-aa$_{20}$-aa$_{21}$-aa$_{22}$-aa$_{23}$-aa$_{24}$-aa$_{25}$-aa$_{26}$-aa$_{27}$-aa$_{28}$-aa$_{29}$-aa$_{30}$-Z Formula III-B wherein:
Z is —OH or —NHR$^3$, wherein R$^3$ is H, unsubstituted or substituted C$_1$-C$_{12}$ alkyl, or a PEG-containing group of less than 10 Da;
aa$_2$ is Gly, MePro or Aib;
aa$_3$ is Gln or Cit;
aa$_6$ is Phe, 2FPhe, MePhe, 2FMePhe or Nal2;
aa$_{10}$ is Tyr, Nal2, Bip, Bip2EtMeO, Glu, Lys or U(X);
aa$_{11}$ is absent or Ser, Asn, Bip or U(X);
aa$_{12}$ is absent or Lys, Glu, Ser or U(X);
aa$_{13}$ is absent or Tyr, Gln, Cit or U(X);
aa$_{14}$ is absent or Leu, Nle, Glu, Lys or U(X);
aa$_{15}$ is absent or Asp, Glu or U(X);
aa$_{16}$ is absent or Ser, Gly, Glu, Ala, Aib, Lys, Arg or U(X);
aa$_{17}$ is absent or Arg, hArg, Gln, Glu, Lys, Cit, Aib or U(X);
aa$_{18}$ is absent or Arg, hArg, Ala, Aib, Ac4c, Ac5c or U(X);
aa$_{19}$ is absent or Ala, Aib or U(X);
aa$_{20}$ is absent or Gln, Lys, Arg, Cit, Glu, Aib or U(X);
aa$_{21}$ is absent or Asp, Glu, Leu, Aib or U(X);
aa$_{22}$ is absent or Phe or U(X)
aa$_{23}$ is absent or Val, Ile, Aib or U(X);
aa$_{24}$ is absent or Ala, Glu, Gln or U(X);
aa$_{25}$ is absent or Trp or U(X);
aa$_{26}$ is absent or Leu or U(X);
aa$_{27}$ is absent or Met, Val, Leu, Nle, Lys or U(X);
aa$_{28}$ is absent or Asn, Glu, Gln, Cit or U(X);
aa$_{29}$ is absent or Thr, Aib or U(X);
aa$_{30}$ is absent or Arg or U(X);
any two of aa$_1$-aa$_{23}$ can optionally be cyclized through their side chains to form a lactam; and
provided that one, or at least one, of aa$_{10}$-aa$_{12}$, aa$_{16}$-aa$_{24}$ and aa$_{28}$ is a natural or unnatural amino acid U covalently attached to a surfactant X.

Specific Embodiment 7: The peptide product for use of any one of Specific Embodiments 1 to Specific Embodiment 6, wherein:
aa$_2$ is Gly, Aib or Ac4c; or
aa$_{12}$ is lysine; or
aa$_{14}$ is leucine; or
aa$_{17}$ is glycine or homoarginine (hArg); or
aa$_{17}$, aa$_{18}$, aa$_{20}$, aa$_{24}$ or aa$_{28}$, or any combination thereof, is lysine attached to a surfactant X; or
aa$_{16}$ and aa$_{20}$ are cyclized through their side chains to form a lactam; or
the peptide comprises one or more Aib residues, such as Aib at aa$_2$; or
the surfactant X comprises an unsubstituted or substituted dodecyl, tetradecyl, hexadecyl or octadecyl alkyl group; or any combination or all of the above.

Specific Embodiment 8: The peptide product for use of any one of Specific Embodiments 1 to Specific Embodiment 7, which is selected from:

(SEQ. ID. NO. 601)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu$_{16}$*-Gln$_{17}$-Ala$_{18}$-Ala$_{19}$-Lys$_{20}$*-Glu$_{21}$-Phe$_{22}$-Ile$_{23}$-Lys(N-omega[1-dodecyl beta-D-glucuronyl])$_{24}$-Trp$_{25}$-Leu$_{26}$-Leu$_{27}$-Gln$_{28}$-Thr$_{29}$-NH$_2$;

(SEQ. ID. NO. 602)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu$_{16}$*-Gln$_{17}$-Ala$_{18}$-Ala$_{19}$-Lys$_{20}$*-Glu$_{21}$-Phe$_{22}$-Ile$_{23}$-Lys(N-omega[1-tetradecyl beta-D-glucuronyl])$_{24}$-Trp$_{25}$-Leu$_{26}$-Leu$_{27}$-Gln$_{28}$-Thr$_{29}$-NH$_2$;

(SEQ. ID. NO. 603)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu$_{16}$*-Gln$_{17}$-Ala$_{18}$-Ala$_{19}$-Lys$_{20}$*-Glu$_{21}$-Phe$_{22}$-Ile$_{23}$-Lys(N-omega[1-hexadecyl beta-D-glucuronyl])$_{24}$-Trp$_{25}$-Leu$_{26}$-Leu$_{27}$-Gln$_{28}$-Thr$_{29}$-NH$_2$;

(SEQ. ID. NO. 604)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu$_{16}$*-Gln$_{17}$-Ala$_{18}$-Ala$_{19}$-Lys$_{20}$*-Glu$_{21}$-Phe$_{22}$-Ile$_{23}$-Lys(N-omega[1-octadecyl beta-D-glucuronyl])$_{24}$-Trp$_{25}$-Leu$_{26}$-Leu$_{27}$-Gln$_{28}$-Thr$_{29}$-NH$_2$;

(SEQ. ID. NO. 630)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-Omega[1-octyl beta-D-melibiouronyl])$_{24}$-Trp$_{25}$-Leu$_{26}$-Leu$_{27}$-Gln$_{28}$-Thr$_{29}$-NH$_2$;

(SEQ. ID. NO. 631)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-Omega[1-dodecyl beta-D-melibiouronyl])$_{24}$-Trp$_{25}$-Leu$_{26}$-Leu$_{27}$-Gln$_{28}$-Thr$_{29}$-NH$_2$;

(SEQ. ID. NO. 632)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-Omega[1-tetradecyl beta-D-melibiouronyl])$_{24}$-Trp$_{25}$-Leu$_{26}$-Leu$_{27}$-Gln$_{28}$-Thr$_{29}$-NH$_2$;

(SEQ. ID. NO. 633)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-Omega[1-hexadecyl beta-D-melibiouronyl])$_{24}$-Trp$_{25}$-Leu$_{26}$-Leu$_{27}$-Gln$_{28}$-Thr$_{29}$-NH$_2$;

(SEQ. ID. NO. 634)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-Omega[1-octadecyl beta-D-melibiouronyl])$_{24}$-Trp$_{25}$-Leu$_{26}$-Leu$_{27}$-Gln$_{28}$-Thr$_{29}$-NH$_2$;

(SEQ. ID. NO. 805)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-Omega[1-hexadecyl alpha-D-melibiouronyl])$_{24}$-Trp$_{25}$-Leu$_{26}$-Leu$_{27}$-Gln$_{28}$-Thr$_{29}$-NH$_2$;

(SEQ. ID. NO. 819)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-tetradecyl alpha-D-melibiouronyl])$_{17}$-Ala$_{18}$-Ala$_{19}$-Lys*$_{20}$-Glu$_{21}$-Phe$_{22}$-Ile$_{23}$-Gln$_{24}$-Trp$_{25}$-Leu$_{26}$-Leu$_{27}$-Gln$_{28}$-Thr$_{29}$-NH$_2$;

(SEQ. ID. NO. 820)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-hexadecyl alpha-D-melibiouronyl])$_{17}$-Ala$_{18}$-Ala$_{19}$-Lys*$_{20}$-Glu$_{21}$-Phe$_{22}$-Ile$_{23}$-Gln$_{24}$-Trp$_{25}$-Leu$_{26}$-Leu$_{27}$-Gln$_{28}$-Thr$_{29}$-NH$_2$;

(SEQ. ID. NO. 821)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-octadecyl alpha-D-melibiouronyl])$_{17}$-Ala$_{18}$-Ala$_{19}$-Lys*$_{20}$-Glu$_{21}$-Phe$_{22}$-Ile$_{23}$-Gln$_{24}$-Trp$_{25}$-Leu$_{26}$-Leu$_{27}$-Gln$_{28}$-Thr$_{29}$-NH$_2$;

(SEQ. ID. NO. 1114)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-dodecyl alpha-D-melibiouronyl])$_{17}$-Ala$_{18}$-Ala$_{19}$-Lys*$_{20}$-Glu$_{21}$-Phe$_{22}$-Ile$_{23}$-Lys(N-omega[1-dodecyl beta-D-glucouronyl])$_{24}$-Trp$_{25}$-Leu$_{26}$-Leu$_{27}$-Gln$_{28}$-Thr$_{29}$-NH$_2$;

(SEQ. ID. NO. 1115)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-tetradecyl alpha-D-melibiouronyl])$_{17}$-Ala$_{18}$-Ala$_{19}$-Lys*$_{20}$-Glu$_{21}$-Phe$_{22}$-Ile$_{23}$-Lys(N-omega[1-tetradecyl beta-D-glucouronyl])$_{24}$-Trp$_{25}$-Leu$_{26}$-Leu$_{27}$-Gln$_{28}$-Thr$_{29}$-NH$_2$;

(SEQ. ID. NO. 1116)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-hexadecyl alpha-D-melibiouronyl])$_{17}$-Ala$_{18}$-Ala$_{19}$-Lys*$_{20}$-Glu$_{21}$-Phe$_{22}$-Ile$_{23}$-Lys(N-omega[1-hexadecyl beta-D-glucouronyl])$_{24}$-Trp$_{25}$-Leu$_{26}$-Leu$_{27}$-Gln$_{28}$-Thr$_{29}$-NH$_2$;

(SEQ. ID. NO. 1117)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-(13-carboxyl-tridecyloxy) beta-D-glucuronyl])$_{17}$-Ala$_{18}$-Ala$_{19}$-Lys*$_{20}$-Glu$_{21}$-Phe$_{22}$-Ile$_{23}$-Gln$_{24}$-Trp$_{25}$-Leu$_{26}$-Leu$_{27}$-Gln$_{28}$-Thr$_{29}$-NH$_2$;

(SEQ. ID. NO. 1118)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-(15-carboxyl-pentadecyloxy) beta-D-glucuronyl])$_{17}$-Ala$_{18}$-Ala$_{19}$-Lys*$_{20}$-Glu$_{21}$-Phe$_{22}$-Ile$_{23}$-Gln$_{24}$-Trp$_{25}$-Leu$_{26}$-Leu$_{27}$-Gln$_{28}$-Thr$_{29}$-NH$_2$;

(SEQ. ID. NO. 1119)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Lys(N-omega[1-(17-carboxyl-heptadecyloxy) beta-D-glucuronyl])$_{17}$-Ala$_{18}$-Ala$_{19}$-Lys*$_{20}$-Glu$_{21}$-Phe$_{22}$-Ile$_{23}$-Gln$_{24}$-Trp$_{25}$-Leu$_{26}$-Leu$_{27}$-Gln$_{28}$-Thr$_{29}$-NH$_2$;

(SEQ. ID. NO. 1120)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-omega[1-(13-carboxyl-tridecyloxy) beta-D-glucuronyl])$_{24}$-Trp$_{25}$-Leu$_{26}$-Leu$_{27}$-Gln$_{28}$-Thr$_{29}$-NH$_2$;

(SEQ. ID. NO. 1121)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-omega[1-(15-carboxyl-pentadecyloxy) beta-D-glucuronyl])$_{24}$-Trp$_{25}$-Leu$_{26}$-Leu$_{27}$-Gln$_{28}$-Thr$_{29}$-NH$_2$;

-continued (SEQ. ID. NO. 1122)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-omega[1-(17-carboxyl-heptadecyloxy) beta-D-glucuronyl])$_{24}$-Trp$_{25}$-Leu$_{26}$-Leu$_{27}$-Gln$_{28}$-Thr$_{29}$-NH$_2$;

(SEQ. ID. NO. 1123)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-omega[1-(13-carboxyl-tridecyloxy) beta-D-melibiouronyl])$_{24}$-Trp$_{25}$-Leu$_{26}$-Leu$_{27}$-Gln$_{28}$-Thr$_{29}$-NH$_2$;

(SEQ. ID. NO. 1124)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-omega[1-(15-carboxyl-pentadecyloxy) beta-D-melibiouronyl])$_{24}$-Trp$_{25}$-Leu$_{26}$-Leu$_{27}$-Gln$_{28}$-Thr$_{29}$-NH$_2$;

(SEQ. ID. NO. 1125)
His$_1$-Aib$_2$-Gln$_3$-Gly$_4$-Thr$_5$-Phe$_6$-Thr$_7$-Ser$_8$-Asp$_9$-Tyr$_{10}$-Ser$_{11}$-Lys$_{12}$-Tyr$_{13}$-Leu$_{14}$-Asp$_{15}$-Glu*$_{16}$-Gln$_{17}$-Ala$_{18}$-Ala$_{19}$-Lys*$_{20}$-Glu$_{21}$-Phe$_{22}$-Ile$_{23}$-Lys(N-omega[1-(17-carboxyl-heptadecyloxy) beta-D-melibiouronyl])$_{24}$-Trp$_{25}$-Leu$_{26}$-Leu$_{27}$-Gln$_{28}$-Thr$_{29}$-NH$_2$;

and pharmaceutically acceptable salts thereof, wherein Glu$_{16}$* and Lys$_{20}$* denote residues that are cyclized through their side chains to form a lactam.

Specific Embodiment 9: The peptide product for use of any one of Specific Embodiments 1 to Specific Embodiment 8, wherein the kidney disorder is chronic kidney disease.

Specific Embodiment 10: The peptide product for use of any one of Specific Embodiments 1 to Specific Embodiment 8, wherein the liver disorder is fatty liver disease, such as non-alcoholic fatty liver disease (NAFLD).

Specific Embodiment 11: The peptide product for use of Specific Embodiment 10, wherein the NAFLD is non-alcoholic steatohepatitis (NASH).

Specific Embodiment 12: The peptide product for use of any one of Specific Embodiments 1 to Specific Embodiment 11, wherein the treatment comprises parenteral (e.g., subcutaneous, intravenous or intramuscular) administration of the peptide product.

Specific Embodiment 13: The peptide product for use of any one of paragraphs Specific Embodiments 1 to Specific Embodiment 12, wherein the treatment comprises administration of the peptide product by oral inhalation or nasal inhalation or insufflation.

Specific Embodiment 14: The peptide product for use of any one of Specific Embodiments 1 to Specific Embodiment 13, wherein the treatment comprises parenteral (e.g., subcutaneous [sc], intravenous [iv] or intramuscular [im]) administration of the peptide product in a dose from about 0.1 mg to about 1, 5 or 10 mg, or about 0.1-1 mg or 1-10 mg, over a period of about one week.

Specific Embodiment 15: The peptide product for use of Specific Embodiment 14, wherein the treatment comprises parenteral (e.g., sc, iv or im) administration of the peptide product in a dose of about 0.1-1 mg, or about 0.1-0.5 mg or 0.5-1 mg, over a period of about one week.

Specific Embodiment 16: The peptide product for use of any one of Specific Embodiments 1 to Specific Embodiment 15, wherein the treatment comprises parenteral (e.g., sc, iv or im) administration of the peptide product once a week.

Specific Embodiment 17: The peptide product for use of any one of Specific Embodiments 1 to Specific Embodiment 16, wherein the treatment further comprises administration of one or more additional therapeutic agents.

Specific Embodiment 18: The peptide product for use of Specific Embodiment 17, wherein the one or more additional therapeutic agents are selected from antidiabetic agents, anti-obesity agents, anti-inflammatory agents, anti-fibrotic agents, antioxidants, anti-hypertensive agents, and combinations thereof.

Specific Embodiment 19: The peptide product for use of Specific Embodiment 17 or Specific Embodiment 18, wherein the liver disorder is NAFLD (e.g., NASH), and the one or more additional therapeutic agents are or include a peroxisome proliferator-activated receptor (PPAR) agonist (e.g., a PPAR-δ agonist such as clafibranor or/and a PPARγ agonist such as pioglitazone), a HMG-CoA reductase inhibitor (e.g., a statin such as rosuvastatin), a farnesoid X receptor (FXR) agonist (e.g., obeticholic acid) or an antioxidant (e.g., vitamin E), or any combination thereof.

Specific Embodiment 20: A kit comprising: a peptide product of any one of Specific Embodiments 1 to Specific Embodiment 8 or a pharmaceutically acceptable salt thereof, or a pharmaceutical composition comprising the same; and instructions for administering or using the peptide product or the pharmaceutical composition to treat polycystic ovary syndrome, a kidney disorder or a liver disorder.

Specific Embodiment 21: The kit of paragraph Specific Embodiment 20, wherein the liver disorder is fatty liver disease, such as NAFLD (e.g., NASH).

Specific Embodiment 22: The kit of Specific Embodiment 20 or Specific Embodiment 21, wherein the peptide product or the pharmaceutical composition is formulated for parenteral administration, such as subcutaneously, intravenously, intramuscularly, or by oral inhalation or nasal inhalation or insufflation.

Specific Embodiment 23: The kit of any one of Specific Embodiments 20 to Specific Embodiment 22, further comprising a device for administering the peptide product or the pharmaceutical composition, such as an injection pen or an inhaler.

SEQUENCE LISTING (1137 sequences)

SEQ ID NO: 1 - protein, 30 aa, Homo sapiens
HAEGTFTSDVSSYLEGQAAKEFIAWLVKGR

SEQ ID NO: 2 - protein, 29 aa, Homo sapiens
HSQGTFTSDYSKYLDSRRAQDFVQWLMNT

SEQ ID NO: 3 - protein, 37 aa, Homo sapiens
HSQGTFTSDYSKYLDSRRAQDFVQWLMNTKRNRNNIA

SEQ ID NO: 4 - protein, 11 aa, Artificial Sequence
  source: /note="Description of Artificial Sequence: Synthetic peptide"
  MOD_RES (2)..(2): Aib
  MOD_RES (11)..(11): Lys(C8)
  source: /note="C-term amide"
HXQGTFTSDLX

SEQ ID NO: 5 - protein, 11 aa, Artificial Sequence
  source: /note="Description of Artificial Sequence: Synthetic peptide"
  MOD_RES (2)..(2): Aib
  MOD_RES (11)..(11): Lys(C12)
  source: /note="C-term amide"
HXQGTFTSDLX

SEQ ID NO: 6 - protein, 11 aa, Artificial Sequence
  source: /note="Description of Artificial Sequence: Synthetic peptide"
  MOD_RES (2)..(2): Aib
  MOD_RES (11)..(11): Lys(C16)
  source: /note="C-term amide"
HXQGTFTSDLX

SEQ ID NO: 7 - protein, 11 aa, Artificial Sequence
  source: /note="Description of Artificial Sequence: Synthetic peptide"
  MOD_RES (2)..(2): Aib
  MOD_RES (10)..(10): Bip
  MOD_RES (11)..(11): Lys(C8)
  source: /note="C-term amide"
HXQGTFTSDXX

SEQ ID NO: 8 - protein, 11 aa, Artificial Sequence
  source: /note="Description of Artificial Sequence: Synthetic peptide"
  MOD_RES (2)..(2): Aib
  MOD_RES (10)..(10): Bip
  MOD_RES (11)..(11): Lys(C12)
  source: /note="C-term amide"
HXQGTFTSDXX

SEQ ID NO: 9 - protein, 11 aa, Artificial Sequence
  source: /note="Description of Artificial Sequence: Synthetic peptide"
  MOD_RES (2)..(2): Aib
  MOD_RES (10)..(10): Bip
  MOD_RES (11)..(11): Lys(C16)
  source: /note="C-term amide"
HXQGTFTSDXX

SEQ ID NO: 10 - protein, 11 aa, Artificial Sequence
  source: /note="Description of Artificial Sequence: Synthetic peptide"
  MOD_RES (2)..(2): Aib
  MOD_RES (10)..(10): Nal(2)
  MOD_RES (11)..(11): Lys(C8)
  source: /note="C-term amide"
HXQGTFTSDXX

SEQ ID NO: 11 - protein, 11 aa, Artificial Sequence
  source: /note="Description of Artificial Sequence: Synthetic peptide"
  MOD_RES (2)..(2): Aib
  MOD_RES (10)..(10): Nal(2)
  MOD_RES (11)..(11): Lys(C12)
  source: /note="C-term amide"
HXQGTFTSDXX

SEQ ID NO: 12 - protein, 11 aa, Artificial Sequence
  source: /note="Description of Artificial Sequence: Synthetic peptide"
  MOD_RES (2)..(2): Aib
  MOD_RES (10)..(10): Nal(2)
  MOD_RES (11)..(11): Lys(C16)
  source: /note="C-term amide"
HXQGTFTSDXX

SEQ ID NO: 13 - protein, 11 aa, Artificial Sequence
  source: /note="Description of Artificial Sequence: Synthetic peptide"
  MOD_RES (2)..(2): Aib
  MOD_RES (6)..(6): 2,6F-Phe
  MOD_RES (10)..(10): Bip2Et4MeO
  MOD_RES (11)..(11): Lys(C8)
  source: /note="C-term amide"
HXQGTXTSDXX

SEQ ID NO: 14 - protein, 11 aa, Artificial Sequence
  source: /note="Description of Artificial Sequence: Synthetic peptide"
  MOD_RES (2)..(2): Aib
  MOD_RES (6)..(6): 2,6F-Phe
  MOD_RES (10)..(10): Bip2Et4MeO
  MOD_RES (11)..(11): Lys(C12)
  source: /note="C-term amide"
HXQGTXTSDXX

SEQ ID NO: 15 - protein, 11 aa, Artificial Sequence
  source: /note="Description of Artificial Sequence: Synthetic peptide"
  MOD_RES (2)..(2): Aib
  MOD_RES (6)..(6): 2,6F-Phe
  MOD_RES (10)..(10): Bip2Et4MeO
  MOD_RES (11)..(11): Lys(C16)
  source: /note="C-term amide"
HXQGTXTSDXX

SEQ ID NO: 16 - protein, 15 aa, Artificial Sequence
  source: /note="Description of Artificial Sequence: Synthetic peptide"
  MOD_RES (2)..(2): Aib
  MOD_RES (15)..(15): Lys(C8)
  source: /note="C-term amide"
HXQGTFTSDLSKYLX

SEQ ID NO: 17 - protein, 15 aa, Artificial Sequence
  source: /note="Description of Artificial Sequence: Synthetic peptide"
  MOD_RES (2)..(2): Aib
  MOD_RES (15)..(15): Lys(C12)
  source: /note="C-term amide"
HXQGTFTSDLSKYLX

SEQ ID NO: 18 - protein, 15 aa, Artificial Sequence
  source: /note="Description of Artificial Sequence: Synthetic peptide"
  MOD_RES (2)..(2): Aib
  MOD_RES (15)..(15): Lys(C16)
  source: /note="C-term amide"
HXQGTFTSDLSKYLX

SEQ ID NO: 19 - protein, 15 aa, Artificial Sequence
  source: /note="Description of Artificial Sequence: Synthetic peptide"
  MOD_RES (2)..(2): Aib
  MOD_RES (10)..(10): Bip
  MOD_RES (15)..(15): Lys(C8)
  source: /note="C-term amide"
HXQGTFTSDXSKYLX

SEQ ID NO: 20 - protein, 15 aa, Artificial Sequence
  source: /note="Description of Artificial Sequence: Synthetic peptide"
  MOD_RES (2)..(2): Aib
  MOD_RES (10)..(10): Bip
  MOD_RES (15)..(15): Lys(C12)
  source: /note="C-term amide"
HXQGTFTSDXSKYLX

SEQ ID NO: 21 - protein, 15 aa, Artificial Sequence
  source: /note="Description of Artificial Sequence: Synthetic peptide"
  MOD_RES (2)..(2): Aib
  MOD_RES (10)..(10): Bip
  MOD_RES (15)..(15): Lys(C16)
  source: /note="C-term amide"
HXQGTFTSDXSKYLX

SEQ ID NO: 22 - protein, 15 aa, Artificial Sequence
  source: /note="Description of Artificial Sequence: Synthetic peptide"
  MOD_RES (2)..(2): Aib
  MOD_RES (10)..(10): Nal(2)
  MOD_RES (15)..(15): Lys(C8)
  source: /note="C-term amide"
HXQGTFTSDXSKYLX

SEQ ID NO: 23 - protein, 15 aa, Artificial Sequence
  source: /note="Description of Artificial Sequence: Synthetic peptide"
  MOD_RES (2)..(2): Aib
  MOD_RES (10)..(10): Nal(2)
  MOD_RES (15)..(15): Lys(C12)
  source: /note="C-term amide"
HXQGTFTSDXSKYLX

SEQ ID NO: 24 - protein, 15 aa, Artificial Sequence
  source: /note="Description of Artificial Sequence: Synthetic peptide"
  MOD_RES (2)..(2): Aib
  MOD_RES (10)..(10): Nal(2)
  MOD_RES (15)..(15): Lys(C16)
  source: /note="C-term amide"
HXQGTFTSDXSKYLX

SEQ ID NO: 25 - protein, 15 aa, Artificial Sequence
  source: /note="Description of Artificial Sequence: Synthetic peptide"
  MOD_RES (2)..(2): Aib
  MOD_RES (6)..(6): 2,6F-Phe
  MOD_RES (10)..(10): Bip2Et4MeO
  MOD_RES (15)..(15): Lys(C8)
  source: /note="C-term amide"
HXQGTXTSDXSKYLX

SEQ ID NO: 26 - protein, 15 aa, Artificial Sequence
  source: /note="Description of Artificial Sequence: Synthetic peptide"
  MOD_RES (2)..(2): Aib
  MOD_RES (6)..(6): 2,6F-Phe
  MOD_RES (10)..(10): Bip2Et4MeO
  MOD_RES (15)..(15): Lys(C12)
  source: /note="C-term amide"
HXQGTXTSDXSKYLX

SEQ ID NO: 27 - protein, 15 aa, Artificial Sequence
  source: /note="Description of Artificial Sequence: Synthetic peptide"
  MOD_RES (2)..(2): Aib
  MOD_RES (6)..(6): 2,6F-Phe
  MOD_RES (10)..(10): Bip2Et4MeO
  MOD_RES (15)..(15): Lys(C16)
  source: /note="C-term amide"
HXQGTXTSDXSKYLX

SEQ ID NO: 28 - protein, 18 aa, Artificial Sequence
  source: /note="Description of Artificial Sequence: Synthetic peptide"
  MOD_RES (2)..(2): Aib
  MOD_RES (18)..(18): Lys(C8)
  source: /note="C-term amide"
HXQGTFTSDVSKYLDGRX

SEQ ID NO: 29 - protein, 18 aa, Artificial Sequence
  source: /note="Description of Artificial Sequence: Synthetic peptide"
  MOD_RES (2)..(2): Aib
  MOD_RES (18)..(18): Lys(C8)
  source: /note="C-term amide"
HXQGTFTSDLSKYLDGRX

SEQ ID NO: 30 - protein, 18 aa, Artificial Sequence
  source: /note="Description of Artificial Sequence: Synthetic peptide"
  MOD_RES (2)..(2): Aib
  MOD_RES (18)..(18): Lys(C12)
  source: /note="C-term amide"
HXQGTFTSDLSKYLDGRX

SEQ ID NO: 31 - protein, 18 aa, Artificial Sequence
  source: /note="Description of Artificial Sequence: Synthetic peptide"
  MOD_RES (2)..(2): Aib
  MOD_RES (18)..(18): Lys(C16)
  source: /note="C-term amide"
HXQGTFTSDLSKYLDGRX

SEQ ID NO: 32 - protein, 18 aa, Artificial Sequence
  source: /note="Description of Artificial Sequence: Synthetic peptide"
  MOD_RES (2)..(2): Aib
  MOD_RES (10)..(10): Bip
  MOD_RES (18)..(18): Lys(C8)
  source: /note="C-term amide"
HXQGTFTSDXSKYLDGRX

SEQ ID NO: 33 - protein, 18 aa, Artificial Sequence
  source: /note="Description of Artificial Sequence: Synthetic peptide"
  MOD_RES (2)..(2): Aib
  MOD_RES (10)..(10): Bip
  MOD_RES (18)..(18): Lys(C12)
  source: /note="C-term amide"
HXQGTFTSDXSKYLDGRX

SEQ ID NO: 34 - protein, 18 aa, Artificial Sequence
  source: /note="Description of Artificial Sequence: Synthetic peptide"
  MOD_RES (2)..(2): Aib
  MOD_RES (10)..(10): Bip
  MOD_RES (18)..(18): Lys(C16)
  source: /note="C-term amide"
HXQGTFTSDXSKYLDGRX

SEQ ID NO: 35 - protein, 18 aa, Artificial Sequence
  source: /note="Description of Artificial Sequence: Synthetic peptide"
  MOD_RES (2)..(2): Aib
  MOD_RES (10)..(10): Nal(2)
  MOD_RES (18)..(18): Lys(C8)
  source: /note="C-term amide"
HXQGTFTSDXSKYLDGRX

SEQ ID NO: 36 - protein, 18 aa, Artificial Sequence
  source: /note="Description of Artificial Sequence: Synthetic peptide"
  MOD_RES (2)..(2): Aib
  MOD_RES (10)..(10): Nal(2)
  MOD_RES (18)..(18): Lys(C12)
  source: /note="C-term amide"
HXQGTFTSDXSKYLDGRX

SEQ ID NO: 37 - protein, 18 aa, Artificial Sequence
  source: /note="Description of Artificial Sequence: Synthetic peptide"
  MOD_RES (2)..(2): Aib
  MOD_RES (10)..(10): Nal(2)
  MOD_RES (18)..(18): Lys(C16)
  source: /note="C-term amide"
HXQGTFTSDXSKYLDGRX

SEQ ID NO: 38 - protein, 18 aa, Artificial Sequence
  source: /note="Description of Artificial Sequence: Synthetic peptide"
  MOD_RES (2)..(2): Aib
  MOD_RES (6)..(6): 2,6F-Phe
  MOD_RES (10)..(10): Bip2Et4MeO
  MOD_RES (18)..(18): Lys(C8)
  source: /note="C-term amide"
HXQGTXTSDXSKYLDGRX

SEQ ID NO: 39 - protein, 18 aa, Artificial Sequence
  source: /note="Description of Artificial Sequence: Synthetic peptide"
  MOD_RES (2)..(2): Aib
  MOD_RES (6)..(6): 2,6F-Phe
  MOD_RES (10)..(10): Bip2Et4MeO
  MOD_RES (18)..(18): Lys(C12)
  source: /note="C-term amide"
HXQGTXTSDXSKYLDGRX

SEQ ID NO: 40 - protein, 18 aa, Artificial Sequence
  source: /note="Description of Artificial Sequence: Synthetic peptide"
  MOD_RES (2)..(2): Aib
  MOD_RES (6)..(6): 2,6F-Phe
  MOD_RES (10)..(10): Bip2Et4MeO
  MOD_RES (18)..(18): Lys(C16)
  source: /note="C-term amide"
HXQGTXTSDXSKYLDGRX

SEQ ID NO: 41 - protein, 11 aa, Artificial Sequence
  source: /note="Description of Artificial Sequence: Synthetic peptide"
  MOD_RES (2)..(2): Aib
  MOD_RES (11)..(11): Lys(C8)
  source: /note="C-term amide"
HXQGTFTSDLX

SEQ ID NO: 42 - protein, 11 aa, Artificial Sequence
  source: /note="Description of Artificial Sequence: Synthetic peptide"
  MOD_RES (2)..(2): Aib
  MOD_RES (11)..(11): Lys(C12)
  source: /note="C-term amide"
HXQGTFTSDLX

SEQ ID NO: 43 - protein, 11 aa, Artificial Sequence
  source: /note="Description of Artificial Sequence: Synthetic peptide"
  MOD_RES (2)..(2): Aib
  MOD_RES (11)..(11): Lys(C16)
  source: /note="C-term amide"
HXQGTFTSDLX

SEQ ID NO: 44 - protein, 11 aa, Artificial Sequence
  source: /note="Description of Artificial Sequence: Synthetic peptide"
  MOD_RES (2)..(2): Aib
  MOD_RES (10)..(10): Bip
  MOD_RES (11)..(11): Lys(C8)
  source: /note="C-term amide"
HXQGTFTSDXX

SEQ ID NO: 45 - protein, 11 aa, Artificial Sequence
  source: /note="Description of Artificial Sequence: Synthetic peptide"
  MOD_RES (2)..(2): Aib
  MOD_RES (10)..(10): Bip
  MOD_RES (11)..(11): Lys(C12)
  source: /note="C-term amide"
HXQGTFTSDXX

SEQ ID NO: 46 - protein, 11 aa, Artificial Sequence
  source: /note="Description of Artificial Sequence: Synthetic peptide"
  MOD_RES (2)..(2): Aib
  MOD_RES (10)..(10): Bip
  MOD_RES (11)..(11): Lys(C16)
  source: /note="C-term amide"
HXQGTFTSDXX

SEQ ID NO: 47 - protein, 11 aa, Artificial Sequence
  source: /note="Description of Artificial Sequence: Synthetic peptide"
  MOD_RES (2)..(2): Aib
  MOD_RES (10)..(10): Nal(2)
  MOD_RES (11)..(11): Lys(C8)
  source: /note="C-term amide"
HXQGTFTSDXX

SEQ ID NO: 48 - protein, 11 aa, Artificial Sequence
  source: /note="Description of Artificial Sequence: Synthetic peptide"
  MOD_RES (2)..(2): Aib
  MOD_RES (10)..(10): Nal(2)
  MOD_RES (11)..(11): Lys(C12)
  source: /note="C-term amide"
HXQGTFTSDXX

SEQ ID NO: 49 - protein, 11 aa, Artificial Sequence
  source: /note="Description of Artificial Sequence: Synthetic peptide"
  MOD_RES (2)..(2): Aib
  MOD_RES (10)..(10): Nal(2)
  MOD_RES (11)..(11): Lys(C16)
  source: /note="C-term amide"
HXQGTFTSDXX

SEQ ID NO: 50 - protein, 11 aa, Artificial Sequence
  source: /note="Description of Artificial Sequence: Synthetic peptide"
  MOD_RES (2)..(2): Aib
  MOD_RES (6)..(6): 2,6F-Phe
  MOD_RES (10)..(10): Bip2Et4MeO
  MOD_RES (11)..(11): Lys(C8)
  source: /note="C-term amide"
HXQGTXTSDXX

SEQ ID NO: 51 - protein, 11 aa, Artificial Sequence
  source: /note="Description of Artificial Sequence: Synthetic peptide"
  MOD_RES (2)..(2): Aib
  MOD_RES (6)..(6): 2,6F-Phe
  MOD_RES (10)..(10): Bip2Et4MeO
  MOD_RES (11)..(11): Lys(C12)
  source: /note="C-term amide"
HXQGTXTSDXX

SEQ ID NO: 52 - protein, 11 aa, Artificial Sequence
  source: /note="Description of Artificial Sequence: Synthetic peptide"
  MOD_RES (2)..(2): Aib
  MOD_RES (6)..(6): 2,6F-Phe
  MOD_RES (10)..(10): Bip2Et4MeO
  MOD_RES (11)..(11): Lys(C16)
  source: /note="C-term amide"
HXQGTXTSDXX

SEQ ID NO: 53 - protein, 11 aa, Artificial Sequence
  source: /note="Description of Artificial Sequence: Synthetic peptide"
  MOD_RES (2)..(2): Aib
  MOD_RES (6)..(6): 2,6Me-Phe
  MOD_RES (10)..(10): Bip
  MOD_RES (11)..(11): Lys(C8)
  source: /note="C-term amide"
HXQGTXTSDXX

SEQ ID NO: 54 - protein, 11 aa, Artificial Sequence
  source: /note="Description of Artificial Sequence: Synthetic peptide"
  MOD_RES (2)..(2): Aib
  MOD_RES (6)..(6): 2,6Me-Phe
  MOD_RES (10)..(10): Bip
  MOD_RES (11)..(11): Lys(C12)
  source: /note="C-term amide"
HXQGTXTSDXX

SEQ ID NO: 55 - protein, 11 aa, Artificial Sequence
  source: /note="Description of Artificial Sequence: Synthetic peptide"
  MOD_RES (2)..(2): Aib
  MOD_RES (6)..(6): 2,6Me-Phe
  MOD_RES (10)..(10): Bip
  MOD_RES (11)..(11): Lys(C16)
  source: /note="C-term amide"
HXQGTXTSDXX

SEQ ID NO: 56 - protein, 15 aa, Artificial Sequence
  source: /note="Description of Artificial Sequence: Synthetic peptide"
  MOD_RES (2)..(2): Aib
  MOD_RES (6)..(6): Me-Phe
  MOD_RES (15)..(15): Lys(C8)
  source: /note="C-term amide"
HXQGTXTSDLSKYLX

SEQ ID NO: 57 - protein, 15 aa, Artificial Sequence
  source: /note="Description of Artificial Sequence: Synthetic peptide"
  MOD_RES (2)..(2): Aib
  MOD_RES (6)..(6): Me-Phe
  MOD_RES (15)..(15): Lys(C12)
  source: /note="C-term amide"
HXQGTXTSDLSKYLX

SEQ ID NO: 58 - protein, 15 aa, Artificial Sequence
  source: /note="Description of Artificial Sequence: Synthetic peptide"
  MOD_RES (2)..(2): Aib
  MOD_RES (6)..(6): Me-Phe
  MOD_RES (15)..(15): Lys(C16)
  source: /note="C-term amide"
HXQGTXTSDLSKYLX

SEQ ID NO: 59 - protein, 15 aa, Artificial Sequence
  source: /note="Description of Artificial Sequence: Synthetic peptide"
  MOD_RES (2)..(2): Aib
  MOD_RES (6)..(6): Me-Phe
  MOD_RES (10)..(10): Bip
  MOD_RES (15)..(15): Lys(C8)
  source: /note="C-term amide"
HXQGTXTSDXSKYLX

SEQ ID NO: 60 - protein, 15 aa, Artificial Sequence
  source: /note="Description of Artificial Sequence: Synthetic peptide"
  MOD_RES (2)..(2): Aib
  MOD_RES (6)..(6): Me-Phe
  MOD_RES (10)..(10): Bip
  MOD_RES (15)..(15): Lys(C12)
  source: /note="C-term amide"
HXQGTXTSDXSKYLX

SEQ ID NO: 61 - protein, 15 aa, Artificial Sequence
  source: /note="Description of Artificial Sequence: Synthetic peptide"
  MOD_RES (2)..(2): Aib
  MOD_RES (6)..(6): Me-Phe
  MOD_RES (10)..(10): Bip
  MOD_RES (15)..(15): Lys(C16)
  source: /note="C-term amide"
HXQGTXTSDXSKYLX

SEQ ID NO: 62 - protein, 15 aa, Artificial Sequence
  source: /note="Description of Artificial Sequence: Synthetic peptide"
  MOD_RES (2)..(2): Aib
  MOD_RES (6)..(6): Me-Phe
  MOD_RES (10)..(10): Nal(2)
  MOD_RES (15)..(15): Lys(C8)
  source: /note="C-term amide"
HXQGTXTSDXSKYLX

SEQ ID NO: 63 - protein, 15 aa, Artificial Sequence
  source: /note="Description of Artificial Sequence: Synthetic peptide"
  MOD_RES (2)..(2): Aib
  MOD_RES (6)..(6): Me-Phe
  MOD_RES (10)..(10): Nal(2)
  MOD_RES (15)..(15): Lys(C12)
  source: /note="C-term amide"
HXQGTXTSDXSKYLX

SEQ ID NO: 64 - protein, 15 aa, Artificial Sequence
  source: /note="Description of Artificial Sequence: Synthetic peptide"
  MOD_RES (2)..(2): Aib
  MOD_RES (6)..(6): Me-Phe
  MOD_RES (10)..(10): Nal(2)
  MOD_RES (15)..(15): Lys(C16)
  source: /note="C-term amide"
HXQGTXTSDXSKYLX

SEQ ID NO: 65 - protein, 15 aa, Artificial Sequence
  source: /note="Description of Artificial Sequence: Synthetic peptide"
  MOD_RES (2)..(2): Aib
  MOD_RES (6)..(6): Me-Phe
  MOD_RES (10)..(10): Bip2Et4MeO
  MOD_RES (15)..(15): Lys(C8)
  source: /note="C-term amide"
HXQGTXTSDXSKYLX

SEQ ID NO: 66 - protein, 15 aa, Artificial Sequence
  source: /note="Description of Artificial Sequence: Synthetic peptide"
  MOD_RES (2)..(2): Aib
  MOD_RES (6)..(6): Me-Phe
  MOD_RES (10)..(10): Bip2Et4MeO
  MOD_RES (15)..(15): Lys(C12)
  source: /note="C-term amide"
HXQGTXTSDXSKYLX

SEQ ID NO: 67 - protein, 15 aa, Artificial Sequence
  source: /note="Description of Artificial Sequence: Synthetic peptide"
  MOD_RES (2)..(2): Aib
  MOD_RES (6)..(6): Me-Phe
  MOD_RES (10)..(10): Bip2Et4MeO
  MOD_RES (15)..(15): Lys(C16)
  source: /note="C-term amide"
HXQGTXTSDXSKYLX

SEQ ID NO: 68 - protein, 17 aa, Artificial Sequence
  source: /note="Description of Artificial Sequence: Synthetic peptide"
  MOD_RES (2)..(2): Aib
  MOD_RES (17)..(17): Lys(C8)
  source: /note="C-term amide"
HXQGTFTSDVSKYLESX

SEQ ID NO: 69 - protein, 17 aa, Artificial Sequence
  source: /note="Description of Artificial Sequence: Synthetic peptide"
  MOD_RES (2)..(2): Aib
  MOD_RES (17)..(17): Lys(C8)
  source: /note="C-term amide"
HXQGTFTSDLSKYLESX

SEQ ID NO: 70 - protein, 17 aa, Artificial Sequence
  source: /note="Description of Artificial Sequence: Synthetic peptide"
  MOD_RES (2)..(2): Aib
  MOD_RES (17)..(17): Lys(C12)
  source: /note="C-term amide"
HXQGTFTSDLSKYLESX

SEQ ID NO: 71 - protein, 17 aa, Artificial Sequence
  source: /note="Description of Artificial Sequence: Synthetic peptide"
  MOD_RES (2)..(2): Aib
  MOD_RES (17)..(17): Lys(C16)
  source: /note="C-term amide"
HXQGTFTSDLSKYLESX

SEQ ID NO: 72 - protein, 17 aa, Artificial Sequence
  source: /note="Description of Artificial Sequence: Synthetic peptide"
  MOD_RES (2)..(2): Aib
  MOD_RES (10)..(10): Bip
  MOD_RES (17)..(17): Lys(C8)
  source: /note="C-term amide"
HXQGTFTSDXSKYLESX

SEQ ID NO: 73 - protein, 17 aa, Artificial Sequence
  source: /note="Description of Artificial Sequence: Synthetic peptide"
  MOD_RES (2)..(2): Aib
  MOD_RES (10)..(10): Bip
  MOD_RES (17)..(17): Lys(C12)
  source: /note="C-term amide"
HXQGTFTSDXSKYLESX

SEQ ID NO: 74 - protein, 17 aa, Artificial Sequence
  source: /note="Description of Artificial Sequence: Synthetic peptide"
  MOD_RES (2)..(2): Aib
  MOD_RES (10)..(10): Bip
  MOD_RES (17)..(17): Lys(C16)
  source: /note="C-term amide"
HXQGTFTSDXSKYLESX

SEQ ID NO: 75 - protein, 17 aa, Artificial Sequence
  source: /note="Description of Artificial Sequence: Synthetic peptide"
  MOD_RES (2)..(2): Aib
  MOD_RES (10)..(10): Nal(2)
  MOD_RES (17)..(17): Lys(C8)
  source: /note="C-term amide"
HXQGTFTSDXSKYLESX

SEQ ID NO: 76 - protein, 17 aa, Artificial Sequence
  source: /note="Description of Artificial Sequence: Synthetic peptide"
  MOD_RES (2)..(2): Aib
  MOD_RES (10)..(10): Nal(2)
  MOD_RES (17)..(17): Lys(C12)
  source: /note="C-term amide"
HXQGTFTSDXSKYLESX

SEQ ID NO: 77 - protein, 17 aa, Artificial Sequence
  source: /note="Description of Artificial Sequence: Synthetic peptide"
  MOD_RES (2)..(2): Aib
  MOD_RES (10)..(10): Nal(2)
  MOD_RES (17)..(17): Lys(C16)
  source: /note="C-term amide"
HXQGTFTSDXSKYLESX

SEQ ID NO: 78 - protein, 17 aa, Artificial Sequence
  source: /note="Description of Artificial Sequence: Synthetic peptide"
  MOD_RES (2)..(2): Aib
  MOD_RES (6)..(6): 2,6F-Phe
  MOD_RES (10)..(10): Bip2Et4MeO
  MOD_RES (17)..(17): Lys(C8)
  source: /note="C-term amide"
HXQGTXTSDXSKYLESX

SEQ ID NO: 79 - protein, 17 aa, Artificial Sequence
  source: /note="Description of Artificial Sequence: Synthetic peptide"
  MOD_RES (2)..(2): Aib
  MOD_RES (6)..(6): 2,6F-Phe
  MOD_RES (10)..(10): Bip2Et4MeO
  MOD_RES (17)..(17): Lys(C12)
  source: /note="C-term amide"
HXQGTXTSDXSKYLESX

SEQ ID NO: 80 - protein, 17 aa, Artificial Sequence
  source: /note="Description of Artificial Sequence: Synthetic peptide"
  MOD_RES (2)..(2): Aib
  MOD_RES (6)..(6): 2,6F-Phe
  MOD_RES (10)..(10): Bip2Et4MeO
  MOD_RES (17)..(17): Lys(C16)
  source: /note="C-term amide"
HXQGTXTSDXSKYLESX

SEQ ID NO: 81 - protein, 17 aa, Artificial Sequence
  source: /note="Description of Artificial Sequence: Synthetic peptide"
  MOD_RES (2)..(2): Aib
  MOD_RES (10)..(10): Bip
  MOD_RES (17)..(17): Lys(C8)
  source: /note="C-term amide"
HXQGTFTSDXSKYLDSX

SEQ ID NO: 82 - protein, 17 aa, Artificial Sequence
  source: /note="Description of Artificial Sequence: Synthetic peptide"
  MOD_RES (2)..(2): Aib
  MOD_RES (10)..(10): Bip
  MOD_RES (17)..(17): Lys(C12)
  source: /note="C-term amide"
HXQGTFTSDXSKYLDSX

SEQ ID NO: 83 - protein, 17 aa, Artificial Sequence
  source: /note="Description of Artificial Sequence: Synthetic peptide"
  MOD_RES (2)..(2): Aib
  MOD_RES (10)..(10): Bip
  MOD_RES (17)..(17): Lys(C16)
  source: /note="C-term amide"
HXQGTFTSDXSKYLDSX

SEQ ID NO: 84 - protein, 17 aa, Artificial Sequence
  source: /note="Description of Artificial Sequence: Synthetic peptide"
  MOD_RES (2)..(2): Aib
  MOD_RES (10)..(10): Bip
  MOD_RES (17)..(17): Lys(C8)
  source: /note="C-term amide"
HXQGTFTSDXSKYLDRX

SEQ ID NO: 85 - protein, 17 aa, Artificial Sequence
  source: /note="Description of Artificial Sequence: Synthetic peptide"
  MOD_RES (2)..(2): Aib
  MOD_RES (10)..(10): Bip
  MOD_RES (17)..(17): Lys(C12)
  source: /note="C-term amide"
HXQGTFTSDXSKYLDRX

SEQ ID NO: 86 - protein, 17 aa, Artificial Sequence
  source: /note="Description of Artificial Sequence: Synthetic peptide"
  MOD_RES (2)..(2): Aib
  MOD_RES (10)..(10): Bip
  MOD_RES (17)..(17): Lys(C16)
  source: /note="C-term amide"
HXQGTFTSDXSKYLDRX

SEQ ID NO: 87 - protein, 17 aa, Artificial Sequence
  source: /note="Description of Artificial Sequence: Synthetic peptide"
  MOD_RES (2)..(2): Aib
  MOD_RES (17)..(17): Lys(C8)
  source: /note="C-term amide"
HXQGTFTSDYSKYLDRX

SEQ ID NO: 88 - protein, 17 aa, Artificial Sequence
  source: /note="Description of Artificial Sequence: Synthetic peptide"
  MOD_RES (2)..(2): Aib
  MOD_RES (17)..(17): Lys(C12)
  source: /note="C-term amide"
HXQGTFTSDYSKYLDRX

SEQ ID NO: 89 - protein, 17 aa, Artificial Sequence
  source: /note="Description of Artificial Sequence: Synthetic peptide"
  MOD_RES (2)..(2): Aib
  MOD_RES (17)..(17): Lys(C16)
  source: /note="C-term amide"
HXQGTFTSDYSKYLDRX

SEQ ID NO: 90 - protein, 17 aa, Artificial Sequence
  source: /note="Description of Artificial Sequence: Synthetic peptide"
  MOD_RES (2)..(2): Aib
  MOD_RES (16)..(16): hArg
  MOD_RES (17)..(17): Lys(C12)
  source: /note="C-term amide"
HXQGTFTSDYSKYLDXX

SEQ ID NO: 91 - protein, 17 aa, Artificial Sequence
  source: /note="Description of Artificial Sequence: Synthetic peptide"
  MOD_RES (2)..(2): Aib
  MOD_RES (10)..(10): Bip
  MOD_RES (17)..(17): Lys(C12)
  source: /note="C-term amide"
HXQGTFTSDXSKYLESX

SEQ ID NO: 92 - protein, 17 aa, Artificial Sequence
  source: /note="Description of Artificial Sequence: Synthetic peptide"
  MOD_RES (2)..(2): Aib
  MOD_RES (6)..(6): Me-Phe
  MOD_RES (10)..(10): Bip
  MOD_RES (17)..(17): Lys(C12)
  source: /note="C-term amide"
HXQGTXTSDXSKYLESX

SEQ ID NO: 93 - protein, 17 aa, Artificial Sequence
  source: /note="Description of Artificial Sequence: Synthetic peptide"
  MOD_RES (2)..(2): Aib
  MOD_RES (6)..(6): Me-Phe
  MOD_RES (10)..(10): Bip
  MOD_RES (12)..(12): Aib
  MOD_RES (17)..(17): Lys(C12)
  source: /note="C-term amide"
HXQGTXTSDXSXYLESX

SEQ ID NO: 94 - protein, 17 aa, Artificial Sequence
  source: /note="Description of Artificial Sequence: Synthetic peptide"
  MOD_RES (2)..(2): Aib
  MOD_RES (6)..(6): Me-Phe
  MOD_RES (10)..(10): Bip
  MOD_RES (16)..(16): Aib
  MOD_RES (17)..(17): Lys(C12)
  source: /note="C-term amide"
HXQGTXTSDXSKYLEXX

SEQ ID NO: 95 - protein, 17 aa, Artificial Sequence
  source: /note="Description of Artificial Sequence: Synthetic peptide"
  MOD_RES (2)..(2): Aib
  MOD_RES (6)..(6): Me-Phe
  MOD_RES (16)..(16): Aib
  MOD_RES (17)..(17): Lys(C12)
  source: /note="C-term amide"
HXQGTXTSDYSKYLDXX

SEQ ID NO: 96 - protein, 17 aa, Artificial Sequence
  source: /note="Description of Artificial Sequence: Synthetic peptide"
  MOD_RES (2)..(2): Aib
  MOD_RES (6)..(6): Me-Phe
  MOD_RES (11)..(11): Aib
  MOD_RES (16)..(16): Aib
  MOD_RES (17)..(17): Lys(C12)
  source: /note="C-term amide"
HXQGTXTSDYXKYLDXX

SEQ ID NO: 97 - protein, 12 aa, Artificial Sequence
  source: /note="Description of Artificial Sequence: Synthetic peptide"
  MOD_RES (2)..(2): Aib
  MOD_RES (6)..(6): Me-Phe
  MOD_RES (11)..(11): Aib
  MOD_RES (12)..(12): Lys(C12)
  source: /note="C-term amide"
HXQGTXTSDYXX

SEQ ID NO: 98 - protein, 12 aa, Artificial Sequence
  source: /note="Description of Artificial Sequence: Synthetic peptide"
  MOD_RES (2)..(2): Aib
  MOD_RES (6)..(6): Me-Phe
  MOD_RES (10)..(10): Nal(2)
  MOD_RES (11)..(11): Aib
  MOD_RES (12)..(12): Lys(C12)
  source: /note="C-term amide"
HXQGTXTSDXXX

SEQ ID NO: 99 - protein, 18 aa, Artificial Sequence
  source: /note="Description of Artificial Sequence: Synthetic peptide"
  MOD_RES (2)..(2): Aib
  MOD_RES (6)..(6): Me-Phe
  MOD_RES (16)..(16): Aib
  MOD_RES (17)..(17): Lys(C12)
  MOD_RES (18)..(18): Aib
  source: /note="C-term amide"
HXQGTXTSDYSKYLDXXX

SEQ ID NO: 100 - protein, 18 aa, Artificial Sequence
  source: /note="Description of Artificial Sequence: Synthetic peptide"
  MOD_RES (2)..(2): Aib
  MOD_RES (6)..(6): Me-Phe
  MOD_RES (10)..(10): Nal(2)
  MOD_RES (16)..(16): Aib
  MOD_RES (17)..(17): Lys(C12)
  MOD_RES (18)..(18): Aib
  source: /note="C-term amide"
HXQGTXTSDXSKYLDXXX

SEQ ID NO: 101 - protein, 17 aa, Artificial Sequence
  source: /note="Description of Artificial Sequence: Synthetic peptide"
  MOD_RES (2)..(2): Aib
  MOD_RES (6)..(6): Me-Phe
  MOD_RES (11)..(11): Aib
  MOD_RES (16)..(16): Aib
  MOD_RES (17)..(17): Lys(C12)
  source: /note="C-term amide"
HXQGTXTSDYXKYLDXX

SEQ ID NO: 102 - protein, 18 aa, Artificial Sequence
  source: /note="Description of Artificial Sequence: Synthetic peptide"
  MOD_RES (2)..(2): Aib
  MOD_RES (6)..(6): Me-Phe
  MOD_RES (11)..(11): Aib
  MOD_RES (16)..(16): Aib
  MOD_RES (17)..(17): Lys(C12)
  MOD_RES (18)..(18): Aib
  source: /note="C-term amide"
HXQGTXTSDYXKYLDXXX

SEQ ID NO: 103 - protein, 18 aa, Artificial Sequence
  source: /note="Description of Artificial Sequence: Synthetic peptide"
  MOD_RES (2)..(2): Aib
  MOD_RES (6)..(6): Me-Phe
  MOD_RES (16)..(16): Aib
  MOD_RES (17)..(17): Lys(C12)
  MOD_RES (18)..(18): Aib
  source: /note="C-term amide"
HXQGTXTSDYSKYLDXXX

SEQ ID NO: 104 - protein, 19 aa, Artificial Sequence
  source: /note="Description of Artificial Sequence: Synthetic peptide"
  MOD_RES (2)..(2): Aib
  MOD_RES (6)..(6): Me-Phe
  MOD_RES (17)..(17): Aib
  MOD_RES (18)..(18): Lys(C12)
  MOD_RES (19)..(19): Aib
  source: /note="C-term amide"
HXQGTXTSDYSKYLDRXXX

SEQ ID NO: 105 - protein, 19 aa, Artificial Sequence
  source: /note="Description of Artificial Sequence: Synthetic peptide"
  MOD_RES (2)..(2): Aib
  MOD_RES (6)..(6): Me-Phe
  MOD_RES (11)..(11): Aib
  MOD_RES (17)..(17): Aib
  MOD_RES (18)..(18): Lys(C12)
  MOD_RES (19)..(19): Aib
  source: /note="C-term amide"
HXQGTXTSDYXKYLDRXXX

SEQ ID NO: 106 - protein, 19 aa, Artificial Sequence
  source: /note="Description of Artificial Sequence: Synthetic peptide"
  MOD_RES (2)..(2): Aib
  MOD_RES (6)..(6): Me-Phe
  MOD_RES (11)..(11): Aib
  MOD_RES (17)..(17): Aib
  MOD_RES (18)..(18): Lys(C12)
  MOD_RES (19)..(19): Ac5c
  source: /note="C-term amide"
HXQGTXTSDYXKYLDRXXX

SEQ ID NO: 107 - protein, 18 aa, Artificial Sequence
  source: /note="Description of Artificial Sequence: Synthetic peptide"
  MOD_RES (2)..(2): Aib
  MOD_RES (6)..(6): Me-Phe
  MOD_RES (10)..(10): Nal(2)
  MOD_RES (11)..(11): Aib
  MOD_RES (17)..(17): Aib
  MOD_RES (18)..(18): Lys(C12)
  source: /note="C-term amide"
HXQGTXTSDXXKYLERXX

SEQ ID NO: 108 - protein, 19 aa, Artificial Sequence
  source: /note="Description of Artificial Sequence: Synthetic peptide"
  MOD_RES (2)..(2): Aib
  MOD_RES (16)..(16): hArg
  MOD_RES (17)..(17): Aib
  MOD_RES (18)..(18): Lys(C8)
  MOD_RES (19)..(19): Aib
  source: /note="C-term amide"
HXQGTFTSDYSKYLDXXXX

SEQ ID NO: 109 - protein, 19 aa, Artificial Sequence
  source: /note="Description of Artificial Sequence: Synthetic peptide"
  MOD_RES (2)..(2): Aib
  MOD_RES (16)..(16): hArg
  MOD_RES (17)..(17): Aib
  MOD_RES (18)..(18): Lys(C12)
  MOD_RES (19)..(19): Aib
  source: /note="C-term amide"
HXQGTFTSDYSKYLDXXXX

SEQ ID NO: 110 - protein, 19 aa, Artificial Sequence
  source: /note="Description of Artificial Sequence: Synthetic peptide"
  MOD_RES (2)..(2): Aib
  MOD_RES (16)..(16): hArg
  MOD_RES (17)..(17): Aib
  MOD_RES (18)..(18): Lys(C16)
  MOD_RES (19)..(19): Aib
  source: /note="C-term amide"
HXQGTFTSDYSKYLDXXXX

SEQ ID NO: 111 - protein, 14 aa, Artificial Sequence
  source: /note="Description of Artificial Sequence: Synthetic peptide"
  MOD_RES (2)..(2): Aib
  MOD_RES (6)..(6): Me-Phe
  MOD_RES (11)..(11): Aib
  MOD_RES (14)..(14): Lys(C12)
  source: /note="C-term amide"
HXQGTXTSDYXKYX

SEQ ID NO: 112 - protein, 14 aa, Artificial Sequence
  source: /note="Description of Artificial Sequence: Synthetic peptide"
  MOD_RES (2)..(2): Aib
  MOD_RES (6)..(6): Me-Phe
  MOD_RES (11)..(11): Aib
  MOD_RES (14)..(14): Lys(C12)
  source: /note="C-term NHEt"
HXQGTXTSDYXKYX

SEQ ID NO: 113 - protein, 15 aa, Artificial Sequence
  source: /note="Description of Artificial Sequence: Synthetic peptide"
  MOD_RES (2)..(2): Aib
  MOD_RES (6)..(6): Me-Phe
  MOD_RES (11)..(11): Aib
  MOD_RES (14)..(14): Lys(C12)
  MOD_RES (15)..(15): Aib
  source: /note="C-term amide"
HXQGTXTSDYXKYXX

SEQ ID NO: 114 - protein, 15 aa, Artificial Sequence
  source: /note="Description of Artificial Sequence: Synthetic peptide"
  MOD_RES (2)..(2): Aib
  MOD_RES (6)..(6): Me-Phe
  MOD_RES (11)..(11): Aib
  MOD_RES (14)..(14): Lys(C12)
  MOD_RES (15)..(15): Aib
  source: /note="C-term NHEt"
HXQGTXTSDYXKYXX

SEQ ID NO: 115 - protein, 15 aa, Artificial Sequence
  source: /note="Description of Artificial Sequence: Synthetic peptide"
  MOD_RES (2)..(2): Aib
  MOD_RES (6)..(6): Me-Phe
  MOD_RES (11)..(11): Aib
  MOD_RES (14)..(14): Lys(C12)
  MOD_RES (15)..(15): Ac5c
  source: /note="C-term amide"
HXQGTXTSDYXKYXX

SEQ ID NO: 116 - protein, 17 aa, Artificial Sequence
  source: /note="Description of Artificial Sequence: Synthetic peptide"
  MOD_RES (2)..(2): Aib
  MOD_RES (6)..(6): Me-Phe
  MOD_RES (16)..(16): Aib
  MOD_RES (17)..(17): Lys(C8)
  source: /note="C-term amide"
HXQGTXTSDYSKYLDXX

SEQ ID NO: 117 - protein, 17 aa, Artificial Sequence
  source: /note="Description of Artificial Sequence: Synthetic peptide"
  MOD_RES (2)..(2): Aib
  MOD_RES (6)..(6): Me-Phe
  MOD_RES (16)..(16): Aib
  MOD_RES (17)..(17): Lys(C16)
  source: /note="C-term amide"
HXQGTXTSDYSKYLDXX

SEQ ID NO: 118 - protein, 17 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C8)
  source: /note="C-term amide"
HXQGTFTSDYSKYLDXX

SEQ ID NO: 119 - protein, 17 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C12)
  source: /note="C-term amide"
HXQGTFTSDYSKYLDXX

SEQ ID NO: 120 - protein, 17 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C16)
  source: /note="C-term amide"
HXQGTFTSDYSKYLDXX

SEQ ID NO: 121 - protein, 19 aa, Artificial Sequence
  source: /note="Description of Artificial Sequence: Synthetic peptide"
  MOD_RES (2)..(2): Aib
  MOD_RES (6)..(6): Me-Phe
  MOD_RES (17)..(17): Aib
  MOD_RES (18)..(18): Lys(C8)
  MOD_RES (19)..(19): Aib
  source: /note="C-term amide"
HXQGTXTSDYSKYLDSXXX

SEQ ID NO: 122 - protein, 19 aa, Artificial Sequence
  source: /note="Description of Artificial Sequence: Synthetic peptide"
  MOD_RES (2)..(2): Aib
  MOD_RES (6)..(6): Me-Phe
  MOD_RES (17)..(17): Aib
  MOD_RES (18)..(18): Lys(C12)
  MOD_RES (19)..(19): Aib
  source: /note="C-term amide"
HXQGTXTSDYSKYLDSXXX

SEQ ID NO: 123 - protein, 19 aa, Artificial Sequence
  source: /note="Description of Artificial Sequence: Synthetic peptide"
  MOD_RES (2)..(2): Aib
  MOD_RES (6)..(6): Me-Phe
  MOD_RES (17)..(17): Aib
  MOD_RES (18)..(18): Lys(C16)
  MOD_RES (19)..(19): Aib
  source: /note="C-term amide"
HXQGTXTSDYSKYLDSXXX

SEQ ID NO: 124 - protein, 19 aa, Artificial Sequence
  source: /note="Description of Artificial Sequence: Synthetic peptide"
  MOD_RES (2)..(2): Aib
  MOD_RES (6)..(6): Me-Phe
  MOD_RES (17)..(17): Aib
  MOD_RES (18)..(18): Lys(C8)
  MOD_RES (19)..(19): Ac5c
  source: /note="C-term amide"
HXQGTXTSDYSKYLDSXXX

SEQ ID NO: 125 - protein, 19 aa, Artificial Sequence
  source: /note="Description of Artificial Sequence: Synthetic peptide"
  MOD_RES (2)..(2): Aib
  MOD_RES (6)..(6): Me-Phe
  MOD_RES (17)..(17): Aib
  MOD_RES (18)..(18): Lys(C12)
  MOD_RES (19)..(19): Ac5c
  source: /note="C-term amide"
HXQGTXTSDYSKYLDSXXX

SEQ ID NO: 126 - protein, 19 aa, Artificial Sequence
  source: /note="Description of Artificial Sequence: Synthetic peptide"
  MOD_RES (2)..(2): Aib
  MOD_RES (6)..(6): Me-Phe
  MOD_RES (17)..(17): Aib
  MOD_RES (18)..(18): Lys(C16)
  MOD_RES (19)..(19): Ac5c
  source: /note="C-term amide"
HXQGTXTSDYSKYLDSXXX

SEQ ID NO: 127 - protein, 19 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C8)
  MOD_RES (19)..(19): Ac5c
  source: /note="C-term amide"
HXQGTFTSDYSKYLDSXXX

SEQ ID NO: 128 - protein, 19 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C12)
  MOD_RES (19)..(19): Ac5c
  source: /note="C-term amide"
HXQGTFTSDYSKYLDSXXX

SEQ ID NO: 129 - protein, 19 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C16)
  MOD_RES (19)..(19): Ac5c
  source: /note="C-term amide"
HXQGTFTSDYSKYLDSXXX

SEQ ID NO: 130 - protein, 20 aa, Artificial Sequence
  source: /note="Description of Artificial Sequence: Synthetic peptide"
  MOD_RES (2)..(2): Aib
  MOD_RES (6)..(6): Me-Phe
  MOD_RES (18)..(18): Aib
  MOD_RES (19)..(19): Lys(C8)
  MOD_RES (20)..(20): Aib
  source: /note="C-term amide"
HXQGTXTSDYSKYLDSRXXX

SEQ ID NO: 131 - protein, 20 aa, Artificial Sequence
  source: /note="Description of Artificial Sequence: Synthetic peptide"
  MOD_RES (2)..(2): Aib
  MOD_RES (6)..(6): Me-Phe
  MOD_RES (18)..(18): Aib
  MOD_RES (19)..(19): Lys(C12)
  MOD_RES (20)..(20): Aib
  source: /note="C-term amide"
HXQGTXTSDYSKYLDSRXXX

SEQ ID NO: 132 - protein, 20 aa, Artificial Sequence
  source: /note="Description of Artificial Sequence: Synthetic peptide"
  MOD_RES (2)..(2): Aib
  MOD_RES (6)..(6): Me-Phe
  MOD_RES (18)..(18): Aib
  MOD_RES (19)..(19): Lys(C16)
  MOD_RES (20)..(20): Aib
  source: /note="C-term amide"
HXQGTXTSDYSKYLDSRXXX

SEQ ID NO: 133 - protein, 20 aa, Artificial Sequence
  source: /note="Description of Artificial Sequence: Synthetic peptide"
  MOD_RES (2)..(2): Aib
  MOD_RES (6)..(6): Me-Phe
  MOD_RES (18)..(18): Aib
  MOD_RES (19)..(19): Lys(C8)
  MOD_RES (20)..(20): Ac5c
  source: /note="C-term amide"
HXQGTXTSDYSKYLDSRXXX

SEQ ID NO: 134 - protein, 20 aa, Artificial Sequence
  source: /note="Description of Artificial Sequence: Synthetic peptide"
  MOD_RES (2)..(2): Aib
  MOD_RES (6)..(6): Me-Phe
  MOD_RES (18)..(18): Aib
  MOD_RES (19)..(19): Lys(C12)
  MOD_RES (20)..(20): Ac5c
  source: /note="C-term amide"
HXQGTXTSDYSKYLDSRXXX

SEQ ID NO: 135 - protein, 20 aa, Artificial Sequence
  source: /note="Description of Artificial Sequence: Synthetic peptide"
  MOD_RES (2)..(2): Aib
  MOD_RES (6)..(6): Me-Phe
  MOD_RES (18)..(18): Aib
  MOD_RES (19)..(19): Lys(C16)
  MOD_RES (20)..(20): Ac5c
  source: /note="C-term amide"
HXQGTXTSDYSKYLDSRXXX

SEQ ID NO: 136 - protein, 20 aa, Artificial Sequence
  source: /note="Description of Artificial Sequence: Synthetic peptide"
  MOD_RES (2)..(2): Aib
  MOD_RES (18)..(18): Aib
  MOD_RES (19)..(19): Lys(C8)
  MOD_RES (20)..(20): Aib
  source: /note="C-term amide"
HXQGTFTSDYSKYLDSRXXX

SEQ ID NO: 137 - protein, 20 aa, Artificial Sequence
  source: /note="Description of Artificial Sequence: Synthetic peptide"
  MOD_RES (2)..(2): Aib
  MOD_RES (18)..(18): Aib
  MOD_RES (19)..(19): Lys(C12)
  MOD_RES (20)..(20): Aib
  source: /note="C-term amide"
HXQGTFTSDYSKYLDSRXXX

SEQ ID NO: 138 - protein, 20 aa, Artificial Sequence
  source: /note="Description of Artificial Sequence: Synthetic peptide"
  MOD_RES (2)..(2): Aib
  MOD_RES (18)..(18): Aib
  MOD_RES (19)..(19): Lys(C16)
  MOD_RES (20)..(20): Aib
  source: /note="C-term amide"
HXQGTFTSDYSKYLDSRXXX

SEQ ID NO: 139 - protein, 23 aa, Artificial Sequence
  source: /note="Description of Artificial Sequence: Synthetic peptide"
  MOD_RES (2)..(2): Aib
  MOD_RES (6)..(6): Me-Phe
  MOD_RES (18)..(18): Aib
  MOD_RES (21)..(21): Lys(C8)
  MOD_RES (23)..(23): Aib
  source: /note="C-term amide"
HXQGTXTSDYSKYLDSRXAQXFX

SEQ ID NO: 140 - protein, 23 aa, Artificial Sequence
  source: /note="Description of Artificial Sequence: Synthetic peptide"
  MOD_RES (2)..(2): Aib
  MOD_RES (6)..(6): Me-Phe
  MOD_RES (18)..(18): Aib
  MOD_RES (21)..(21): Lys(C12)
  MOD_RES (23)..(23): Aib
  source: /note="C-term amide"
HXQGTXTSDYSKYLDSRXAQXFX

SEQ ID NO: 141 - protein, 23 aa, Artificial Sequence
  source: /note="Description of Artificial Sequence: Synthetic peptide"
  MOD_RES (2)..(2): Aib
  MOD_RES (6)..(6): Me-Phe
  MOD_RES (18)..(18): Aib
  MOD_RES (21)..(21): Lys(C16)
  MOD_RES (23)..(23): Aib
  source: /note="C-term amide"
HXQGTXTSDYSKYLDSRXAQXFX

SEQ ID NO: 142 - protein, 23 aa, Artificial Sequence
  source: /note="Description of Artificial Sequence: Synthetic peptide"
  MOD_RES (2)..(2): Aib
  MOD_RES (6)..(6): Me-Phe
  MOD_RES (18)..(18): Aib
  MOD_RES (21)..(21): Lys(C8)
  MOD_RES (23)..(23): Aib
  source: /note="C-term amide"
HXQGTXTSDYSKYLDSRXAQXFX

SEQ ID NO: 143 - protein, 23 aa, Artificial Sequence
  source: /note="Description of Artificial Sequence: Synthetic peptide"
  MOD_RES (2)..(2): Aib
  MOD_RES (6)..(6): Me-Phe
  MOD_RES (18)..(18): Aib
  MOD_RES (21)..(21): Lys(C12)
  MOD_RES (23)..(23): Aib
  source: /note="C-term amide"
HXQGTXTSDYSKYLDSRXAQXFX

SEQ ID NO: 144 - protein, 23 aa, Artificial Sequence
  source: /note="Description of Artificial Sequence: Synthetic peptide"
  MOD_RES (2)..(2): Aib
  MOD_RES (6)..(6): Me-Phe
  MOD_RES (18)..(18): Aib
  MOD_RES (21)..(21): Lys(C16)
  MOD_RES (23)..(23): Aib
  source: /note="C-term amide"
HXQGTXTSDYSKYLDSRXAQXFX

SEQ ID NO: 145 - protein, 23 aa, Artificial Sequence
  source: /note="Description of Artificial Sequence: Synthetic peptide"
  MOD_RES (2)..(2): Aib
  MOD_RES (6)..(6): Me-Phe
  MOD_RES (18)..(18): Aib
  MOD_RES (21)..(21): Lys(C8)
  MOD_RES (23)..(23): Ac5c
  source: /note="C-term amide"
HXQGTXTSDYSKYLDSRXAQXFX

SEQ ID NO: 146 - protein, 23 aa, Artificial Sequence
  source: /note="Description of Artificial Sequence: Synthetic peptide"
  MOD_RES (2)..(2): Aib
  MOD_RES (6)..(6): Me-Phe
  MOD_RES (18)..(18): Aib
  MOD_RES (21)..(21): Lys(C12)
  MOD_RES (23)..(23): Ac5c
  source: /note="C-term amide"
HXQGTXTSDYSKYLDSRXAQXFX

SEQ ID NO: 147 - protein, 23 aa, Artificial Sequence
  source: /note="Description of Artificial Sequence: Synthetic peptide"
  MOD_RES (2)..(2): Aib
  MOD_RES (6)..(6): Me-Phe
  MOD_RES (18)..(18): Aib
  MOD_RES (21)..(21): Lys(C16)
  MOD_RES (23)..(23): Ac5c
  source: /note="C-term amide"
HXQGTXTSDYSKYLDSRXAQXFX

SEQ ID NO: 148 - protein, 23 aa, Artificial Sequence
  source: /note="Description of Artificial Sequence: Synthetic peptide"
  MOD_RES (2)..(2): Aib
  MOD_RES (6)..(6): Me-Phe
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Aib
  MOD_RES (21)..(21): Lys(C8)
  MOD_RES (23)..(23): Aib
  source: /note="C-term amide"
HXQGTXTSDYSEYLDKRXAQXFX

SEQ ID NO: 149 - protein, 23 aa, Artificial Sequence
  source: /note="Description of Artificial Sequence: Synthetic peptide"
  MOD_RES (2)..(2): Aib
  MOD_RES (6)..(6): Me-Phe
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Aib
  MOD_RES (21)..(21): Lys(C12)
  MOD_RES (23)..(23): Aib
  source: /note="C-term amide"
HXQGTXTSDYSEYLDKRXAQXFX

SEQ ID NO: 150 - protein, 23 aa, Artificial Sequence
  source: /note="Description of Artificial Sequence: Synthetic peptide"
  MOD_RES (2)..(2): Aib
  MOD_RES (6)..(6): Me-Phe
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Aib
  MOD_RES (21)..(21): Lys(C16)
  MOD_RES (23)..(23): Aib
  source: /note="C-term amide"
HXQGTXTSDYSEYLDKRXAQXFX

SEQ ID NO: 151 - protein, 23 aa, Artificial Sequence
  source: /note="Description of Artificial Sequence: Synthetic peptide"
  MOD_RES (2)..(2): Aib
  MOD_RES (6)..(6): Me-Phe
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Aib
  MOD_RES (21)..(21): Lys(C8)
  MOD_RES (23)..(23): Ac5c
  source: /note="C-term amide"
HXQGTXTSDYSEYLDKRXAQXFX

SEQ ID NO: 152 - protein, 23 aa, Artificial Sequence
  source: /note="Description of Artificial Sequence: Synthetic peptide"
  MOD_RES (2)..(2): Aib
  MOD_RES (6)..(6): Me-Phe
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Aib
  MOD_RES (21)..(21): Lys(C12)
  MOD_RES (23)..(23): Ac5c
  source: /note="C-term amide"
HXQGTXTSDYSEYLDKRXAQXFX

SEQ ID NO: 153 - protein, 23 aa, Artificial Sequence
  source: /note="Description of Artificial Sequence: Synthetic peptide"
  MOD_RES (2)..(2): Aib
  MOD_RES (6)..(6): Me-Phe
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Aib
  MOD_RES (21)..(21): Lys(C16)
  MOD_RES (23)..(23): Ac5c
  source: /note="C-term amide"
HXQGTXTSDYSEYLDKRXAQXFX

SEQ ID NO: 154 - protein, 23 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Aib
  MOD_RES (21)..(21): Lys(C8)
  MOD_RES (23)..(23): Ac5c
  source: /note="C-term amide"
HXQGTFTSDYSEYLDKRXAQXFX

SEQ ID NO: 155 - protein, 23 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Aib
  MOD_RES (21)..(21): Lys(C12)
  MOD_RES (23)..(23): Ac5c
  source: /note="C-term amide"
HXQGTFTSDYSEYLDKRXAQXFX

SEQ ID NO: 156 - protein, 23 aa, Artificial Sequence
  source: /note="Description of Artificial Sequence: Synthetic peptide"
  MOD_RES (2)..(2): Aib
  SITE (12)..(12): /note="Glu cyclized through side chain to form a lactam linkage"
  SITE (16)..(16): /note="Lys cyclized through side chain to form a lactam linkage"
  MOD_RES (18)..(18): Aib
  MOD_RES (21)..(21): Lys(C16)
  MOD_RES (23)..(23): Ac5c
  source: /note="C-term amide"
HXQGTFTSDYSEYLDKRXAQXFX

SEQ ID NO: 157 - protein, 23 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Aib
  MOD_RES (21)..(21): Lys(C8)
  MOD_RES (23)..(23): Aib
  source: /note="C-term amide"
HXQGTFTSDYSEYLDKRXAQXFX

SEQ ID NO: 158 - protein, 23 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Aib
  MOD_RES (21)..(21): Lys(C12)
  MOD_RES (23)..(23): Aib
  source: /note="C-term amide"
HXQGTFTSDYSEYLDKRXAQXFX

SEQ ID NO: 159 - protein, 23 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Aib
  MOD_RES (21)..(21): Lys(C16)
  MOD_RES (23)..(23): Aib
  source: /note="C-term amide"
HXQGTFTSDYSEYLDKRXAQXFX

SEQ ID NO: 160 - protein, 23 aa, Artificial Sequence
  source: /note="Description of Artificial Sequence: Synthetic peptide"
  MOD_RES (2)..(2): Aib
  MOD_RES (6)..(6): Me-Phe
  SITE (16)..(20): /note="Cyclic"
  SITE (16)..(16): /note="Glu cyclized through side chain to form a lactam linkage"
  MOD_RES (18)..(18): Aib
  SITE (20)..(20): /note="Lys cyclized through side chain to form a lactam linkage"
  MOD_RES (21)..(21): Lys(C8)
  MOD_RES (23)..(23): Aib
  source: /note="C-term amide"
HXQGTXTSDYSKYLDERXAKXFX

SEQ ID NO: 161 - protein, 23 aa, Artificial Sequence
  source: /note="Description of Artificial Sequence: Synthetic peptide"
  MOD_RES (2)..(2): Aib
  MOD_RES (6)..(6): Me-Phe
  SITE (16)..(20): /note="Cyclic"
  SITE (16)..(16): /note="Glu cyclized through side chain to form a lactam linkage"
  MOD_RES (18)..(18): Aib
  SITE (20)..(20): /note="Lys cyclized through side chain to form a lactam linkage"
  MOD_RES (21)..(21): Lys(C12)
  MOD_RES (23)..(23): Aib
  source: /note="C-term amide"
HXQGTXTSDYSKYLDERXAKXFX

SEQ ID NO: 162 - protein, 23 aa, Artificial Sequence
  source: /note="Description of Artificial Sequence: Synthetic peptide"
  MOD_RES (2)..(2): Aib
  MOD_RES (6)..(6): Me-Phe
  SITE (16)..(16): /note="Glu cyclized through side chain to form a lactam linkage"
  MOD_RES (18)..(18): Aib
  SITE (20)..(20): /note="Lys cyclized through side chain to form a lactam linkage"
  MOD_RES (21)..(21): Lys(C16)
  MOD_RES (23)..(23): Aib
  source: /note="C-term amide"
HXQGTXTSDYSKYLDERXAKXFX

SEQ ID NO: 163 - protein, 23 aa, Artificial Sequence
  source: /note="Description of Artificial Sequence: Synthetic peptide"
  MOD_RES (2)..(2): Aib
  MOD_RES (6)..(6): Me-Phe
  SITE (16)..(20): /note="Cyclic"
  SITE (16)..(16): /note="Glu cyclized through side chain to form a lactam linkage"
  MOD_RES (18)..(18): Aib
  SITE (20)..(20): /note="Lys cyclized through side chain to form a lactam linkage"
  MOD_RES (21)..(21): Lys(C8)
  MOD_RES (23)..(23): Ac5c
  source: /note="C-term amide"
HXQGTXTSDYSKYLDERXAKXFX

SEQ ID NO: 164 - protein, 23 aa, Artificial Sequence
  source: /note="Description of Artificial Sequence: Synthetic peptide"
  MOD_RES (2)..(2): Aib
  MOD_RES (6)..(6): Me-Phe
  SITE (16)..(16): /note="Lys cyclized through side chain to form a lactam linkage"
  MOD_RES (18)..(18): Aib
  SITE (20)..(20): /note="Lys cyclized through side chain to form a lactam linkage"
  MOD_RES (21)..(21): Lys(C12)
  MOD_RES (23)..(23): Ac5c
  source: /note="C-term amide"
HXQGTXTSDYSKYLDKRXAKXFX

SEQ ID NO: 165 - protein, 23 aa, Artificial Sequence
  source: /note="Description of Artificial Sequence: Synthetic peptide"
  MOD_RES (2)..(2): Aib
  MOD_RES (6)..(6): Me-Phe
  SITE (16)..(16): /note="Lys cyclized through side chain to form a lactam linkage"
  MOD_RES (18)..(18): Aib
  SITE (20)..(20): /note="Lys cyclized through side chain to form a lactam linkage"
  MOD_RES (21)..(21): Lys(C16)
  MOD_RES (23)..(23): Ac5c
  source: /note="C-term amide"
HXQGTXTSDYSKYLDKRXAKXFX

SEQ ID NO: 166 - protein, 23 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (18)..(18): Aib
  SITE (20)..(20): /note="Lys cyclized through side chain to form a lactam linkage"
  MOD_RES (21)..(21): Lys(C8)
  MOD_RES (23)..(23): Aib
  source: /note="C-term amide"
HXQGTFTSDYSKYLDERXAKXFX

SEQ ID NO: 167 - protein, 23 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (18)..(18): Aib
  SITE (20)..(20): /note="Lys cyclized through side chain to form a lactam linkage"
  MOD_RES (21)..(21): Lys(C12)
  MOD_RES (23)..(23): Aib
  source: /note="C-term amide"
HXQGTFTSDYSKYLDERXAKXFX

SEQ ID NO: 168 - protein, 23 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (18)..(18): Aib
  SITE (20)..(20): /note="Lys cyclized through side chain to form a lactam linkage"
  MOD_RES (21)..(21): Lys(C16)
  MOD_RES (23)..(23): Aib
  source: /note="C-term amide"
HXQGTFTSDYSKYLDERXAKXFX

SEQ ID NO: 169 - protein, 23 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (18)..(18): Aib
  SITE (20)..(20): /note="Lys cyclized through side chain to form a lactam linkage"
  MOD_RES (21)..(21): Lys(C8)
  MOD_RES (23)..(23): Ac5c
  source: /note="C-term amide"
HXQGTFTSDYSKYLDERXAKXFX

SEQ ID NO: 170 - protein, 23 aa, Artificial Sequence
  source: /note="Description of Artificial Sequence: Synthetic peptide"
  MOD_RES (2)..(2): Aib
  SITE (16)..(16): /note="Lys cyclized through side chain to form a lactam linkage"
  MOD_RES (18)..(18): Aib
  SITE (20)..(20): /note="Lys cyclized through side chain to form a lactam linkage"
  MOD_RES (21)..(21): Lys(C12)
  MOD_RES (23)..(23): Ac5c
  source: /note="C-term amide"
HXQGTFTSDYSKYLDKRXAKXFX

SEQ ID NO: 171 - protein, 23 aa, Artificial Sequence
  source: /note="Description of Artificial Sequence: Synthetic peptide"
  MOD_RES (2)..(2): Aib
  SITE (16)..(16): /note="Lys cyclized through side chain to form a lactam linkage"
  MOD_RES (18)..(18): Aib
  SITE (20)..(20): /note="Lys cyclized through side chain to form a lactam linkage"
  MOD_RES (21)..(21): Lys(C16)
  MOD_RES (23)..(23): Ac5c
  source: /note="C-term amide"
HXQGTFTSDYSKYLDKRXAKXFX

SEQ ID NO: 172 - protein, 23 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (21)..(21): Lys(C12)
  MOD_RES (23)..(23): Aib
  source: /note="C-term amide"
HXQGTFTSDYSKYLDEQAAKXFX

SEQ ID NO: 173 - protein, 23 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (21)..(21): Lys(C16)
  MOD_RES (23)..(23): Aib
  source: /note="C-term amide"
HXQGTFTSDYSKYLDEQAAKXFX

SEQ ID NO: 174 - protein, 23 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (21)..(21): Lys(C12)
  MOD_RES (23)..(23): Aib
  source: /note="C-term amide"
HXQGTFTSDYSKYLDERAAKXFX

SEQ ID NO: 175 - protein, 23 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (21)..(21): Lys(C16)
  MOD_RES (23)..(23): Aib
  source: /note="C-term amide"
HXQGTFTSDYSKYLDERAAKXFX

SEQ ID NO: 176 - protein, 23 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (21)..(21): Lys(C12)
  MOD_RES (23)..(23): Ac5c
  source: /note="C-term amide"
HXQGTFTSDYSKYLDERAAKXFX

SEQ ID NO: 177 - protein, 23 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (21)..(21): Lys(C16)
  MOD_RES (23)..(23): Ac5c
  source: /note="C-term amide"
HXQGTFTSDYSKYLDERAAKXFX

SEQ ID NO: 178 - protein, 23 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (21)..(21): Lys(C12)
  MOD_RES (23)..(23): Ac5c
  source: /note="C-term amide"
HXQGTFTSDYSKYLDEQAAKXFX

SEQ ID NO: 179 - protein, 23 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (21)..(21): Lys(C12)
  MOD_RES (23)..(23): Aib
  source: /note="C-term amide"
HXQGTFTSDYSRYLDERAAKXFX

SEQ ID NO: 180 - protein, 19 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C12)
  MOD_RES (19)..(19): Aib
  source: /note="C-term amide"
HXQGTFTSDYSKYLDSXXX

SEQ ID NO: 181 - protein, 19 aa, Artificial Sequence
  source: /note="Description of Artificial Sequence: Synthetic peptide"
  MOD_RES (2)..(2): Aib
  MOD_RES (18)..(18): Lys(C12)
  MOD_RES (19)..(19): Aib
  source: /note="C-term amide"
HXQGTFTSDYSKYLDSRXX

SEQ ID NO: 182 - protein, 19 aa, Artificial Sequence
  source: /note="Description of Artificial Sequence: Synthetic peptide"
  MOD_RES (2)..(2): Aib
  MOD_RES (18)..(18): Lys(C12)
  MOD_RES (19)..(19): Ac5c
  source: /note="C-term amide"
HXQGTFTSDYSKYLDSRXX

SEQ ID NO: 183 - protein, 19 aa, Artificial Sequence
  source: /note="Description of Artificial Sequence: Synthetic peptide"
  MOD_RES (2)..(2): Aib
  MOD_RES (18)..(18): Lys(C8)
  MOD_RES (19)..(19): Aib
  source: /note="C-term amide"
HXQGTFTSDYSKYLDSRXX

SEQ ID NO: 184 - protein, 19 aa, Artificial Sequence
  source: /note="Description of Artificial Sequence: Synthetic peptide"
  MOD_RES (2)..(2): Aib
  MOD_RES (18)..(18): Lys(C16)
  MOD_RES (19)..(19): Aib
  source: /note="C-term amide"
HXQGTFTSDYSKYLDSRXX

SEQ ID NO: 185 - protein, 19 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C12)
  MOD_RES (19)..(19): Aib
  source: /note="C-term amide"
HXQGTFTSDYSKYLDSXXX

SEQ ID NO: 186 - protein, 19 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C8)
  MOD_RES (19)..(19): Aib
  source: /note="C-term amide"
HXQGTFTSDYSKYLDSXXX

SEQ ID NO: 187 - protein, 19 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C1)
  MOD_RES (19)..(19): Aib
  source: /note="C-term amide"
HXQGTFTSDYSKYLDSXXX

SEQ ID NO: 188 - protein, 19 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C16)
  MOD_RES (19)..(19): Aib
  source: /note="C-term amide"
HXQGTFTSDYSKYLDSXXX

SEQ ID NO: 189 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (17)..(17): Aib
  MOD_RES (18)..(18): Lys(C16)
  MOD_RES (19)..(19): Aib
  source: /note="C-term amide"
HXQGTFTSDYSKYLDEXXX

SEQ ID NO: 190 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (17)..(17): Aib
  MOD_RES (18)..(18): Lys(C12)
  MOD_RES (19)..(19): Aib
  source: /note="C-term amide"
HXQGTFTSDYSKYLDEXXX

SEQ ID NO: 191 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (17)..(17): Aib
  MOD_RES (18)..(18): Lys(C8)
  MOD_RES (19)..(19): Aib
  source: /note="C-term amide"
HXQGTFTSDYSKYLDEXXX

SEQ ID NO: 192 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C16)
  MOD_RES (19)..(19): Aib
  source: /note="C-term amide"
HXQGTFTSDYSKYLDERXX

SEQ ID NO: 193 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C12)
  MOD_RES (19)..(19): Aib
  source: /note="C-term amide"
HXQGTFTSDYSKYLDERXX

SEQ ID NO: 194 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C8)
  MOD_RES (19)..(19): Aib
  source: /note="C-term amide"
HXQGTFTSDYSKYLDERXX

SEQ ID NO: 195 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C12)
  MOD_RES (19)..(19): Ac5c
  source: /note="C-term amide"
HXQGTFTSDYSKYLDERXX

SEQ ID NO: 196 - protein, 18 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C8)
  source: /note="C-term amide"
HXQGTFTSDYSKYLDRXX

SEQ ID NO: 197 - protein, 18 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C12)
  source: /note="C-term amide"
HXQGTFTSDYSKYLDRXX

SEQ ID NO: 198 - protein, 18 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C16)
  source: /note="C-term amide"
HXQGTFTSDYSKYLDRXX

SEQ ID NO: 199 - protein, 19 aa, Artificial Sequence
  source: /note="Description of Artificial Sequence: Synthetic peptide"
  MOD_RES (2)..(2): Aib
  MOD_RES (18)..(18): Aib
  MOD_RES (19)..(19): Lys(C8)
  source: /note="C-term amide"
HXQGTFTSDYSKYLDSRXX

SEQ ID NO: 200 - protein, 19 aa, Artificial Sequence
  source: /note="Description of Artificial Sequence: Synthetic peptide"
  MOD_RES (2)..(2): Aib
  MOD_RES (18)..(18): Aib
  MOD_RES (19)..(19): Lys(C12)
  source: /note="C-term amide"
HXQGTFTSDYSKYLDSRXX

SEQ ID NO: 201 - protein, 19 aa, Artificial Sequence
  source: /note="Description of Artificial Sequence: Synthetic peptide"
  MOD_RES (2)..(2): Aib
  MOD_RES (18)..(18): Aib
  MOD_RES (19)..(19): Lys(C16)
  source: /note="C-term amide"
HXQGTFTSDYSKYLDSRXX

SEQ ID NO: 202 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Aib
  MOD_RES (19)..(19): Lys(C8)
  source: /note="C-term amide"
HXQGTFTSDYSKYLDXRXX

SEQ ID NO: 203 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Aib
  MOD_RES (19)..(19): Lys(C12)
  source: /note="C-term amide"
HXQGTFTSDYSKYLDXRXX

SEQ ID NO: 204 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Aib
  MOD_RES (19)..(19): Lys(C16)
  source: /note="C-term amide"
HXQGTFTSDYSKYLDXRXX

SEQ ID NO: 205 - protein, 18 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C8)
  source: /note="C-term amide"
HXQGTFTSDVSSYLERXX

SEQ ID NO: 206 - protein, 18 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C12)
  source: /note="C-term amide"
HXQGTFTSDVSSYLERXX

SEQ ID NO: 207 - protein, 18 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C16)
  source: /note="C-term amide"
HXQGTFTSDVSSYLERXX

SEQ ID NO: 208 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (18)..(19): Lys(C8)
  source: /note="C-term amide"
HXQGTFTSDVSSYLEXRXX

SEQ ID NO: 209 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (18)..(19): Lys(C12)
  source: /note="C-term amide"
HXQGTFTSDVSSYLEXRXX

SEQ ID NO: 210 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (18)..(19): Lys(C16)
  source: /note="C-term amide"
HXQGTFTSDVSSYLEXRXX

SEQ ID NO: 211 - protein, 18 aa, Artificial Sequence
  source: /note="Description of Artificial Sequence: Synthetic peptide"
  MOD_RES (2)..(2): Aib
  MOD_RES (16)..(16): hArg
  MOD_RES (17)..(17): Aib
  MOD_RES (18)..(18): Lys(C8)
  source: /note="C-term amide"
HXQGTFTSDYSKYLDXXX

SEQ ID NO: 212 - protein, 18 aa, Artificial Sequence
  source: /note="Description of Artificial Sequence: Synthetic peptide"
  MOD_RES (2)..(2): Aib
  MOD_RES (16)..(16): hArg
  MOD_RES (17)..(17): Aib
  MOD_RES (18)..(18): Lys(C12)
  source: /note="C-term amide"
HXQGTFTSDYSKYLDXXX

SEQ ID NO: 213 - protein, 18 aa, Artificial Sequence
  source: /note="Description of Artificial Sequence: Synthetic peptide"
  MOD_RES (2)..(2): Aib
  MOD_RES (16)..(16): hArg
  MOD_RES (17)..(17): Aib
  MOD_RES (18)..(18): Lys(C16)
  source: /note="C-term amide"
HXQGTFTSDYSKYLDXXX

SEQ ID NO: 214 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): hArg
  MOD_RES (18)..(18): Aib
  MOD_RES (19)..(19): Lys(C8)
  source: /note="C-term amide"
HXQGTFTSDYSKYLDXXXX

SEQ ID NO: 215 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): hArg
  MOD_RES (18)..(18): Aib
  MOD_RES (19)..(19): Lys(C12)
  source: /note="C-term amide"
HXQGTFTSDYSKYLDXXXX

SEQ ID NO: 216 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): hArg
  MOD_RES (18)..(18): Aib
  MOD_RES (19)..(19): Lys(C16)
  source: /note="C-term amide"
HXQGTFTSDYSKYLDXXXX

SEQ ID NO: 217 - protein, 18 aa, Artificial Sequence
  source: /note="Description of Artificial Sequence: Synthetic peptide"
  MOD_RES (2)..(2): Aib
  MOD_RES (16)..(16): hArg
  MOD_RES (17)..(17): Aib
  MOD_RES (18)..(18): Lys(C8)
  source: /note="C-term amide"
HXQGTFTSDVSSYLEXXX

SEQ ID NO: 218 - protein, 18 aa, Artificial Sequence
  source: /note="Description of Artificial Sequence: Synthetic peptide"
  MOD_RES (2)..(2): Aib
  MOD_RES (16)..(16): hArg
  MOD_RES (17)..(17): Aib
  MOD_RES (18)..(18): Lys(C12)
  source: /note="C-term amide"
HXQGTFTSDVSSYLEXXX

SEQ ID NO: 219 - protein, 22 aa, Artificial Sequence
  source: /note="Description of Artificial Sequence: Synthetic peptide"
  MOD_RES (21)..(21): Lys(C12)
  MOD_RES (22)..(22): Aib
  source: /note="C-term amide"
HSQGTFTSDYSKYLDSRRAQXX

SEQ ID NO: 220 - protein, 21 aa, Artificial Sequence
  source: /note="Description of Artificial Sequence: Synthetic peptide"
  MOD_RES (20)..(20): Lys(C12)
  MOD_RES (21)..(21): Aib
  source: /note="C-term amide"
HSQGTFTSDYSKYLDSRRAXX

SEQ ID NO: 221 - protein, 20 aa, Artificial Sequence
  source: /note="Description of Artificial Sequence: Synthetic peptide"
  MOD_RES (19)..(19): Lys(C12)
  MOD_RES (20)..(20): Aib
  source: /note="C-term amide"
HSQGTFTSDYSKYLDSRRXX

SEQ ID NO: 222 - protein, 19 aa, Artificial Sequence
  source: /note="Description of Artificial Sequence: Synthetic peptide"
  MOD_RES (18)..(18): Lys(C12)
  MOD_RES (19)..(19): Aib
  source: /note="C-term amide"
HSQGTFTSDYSKYLDSRXX

SEQ ID NO: 223 - protein, 18 aa, Artificial Sequence
  source: /note="Description of Artificial Sequence: Synthetic peptide"
  MOD_RES (17)..(17): Lys(C12)
  MOD_RES (18)..(18): Aib
  source: /note="C-term amide"
HSQGTFTSDYSKYLDSXX

SEQ ID NO: 224 - protein, 17 aa, Artificial Sequence
  source: /note="Description of Artificial Sequence: Synthetic peptide"
  MOD_RES (16)..(16): Lys(C12)
  MOD_RES (17)..(17): Aib
  source: /note="C-term amide"
HSQGTFTSDYSKYLDXX

SEQ ID NO: 225 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C12)
  source: /note="C-term amide"
HXQGTFTSDYSKYLDEQAAKEFIXWLMNT

SEQ ID NO: 226 - protein, 21 aa, Artificial Sequence
  source: /note="Description of Artificial Sequence: Synthetic peptide"
  MOD_RES (21)..(21): Lys(C12)
  source: /note="C-term amide"
HSQGTFTSDYSKYLDSRRAQX

SEQ ID NO: 227 - protein, 20 aa, Artificial Sequence
  source: /note="Description of Artificial Sequence: Synthetic peptide"
  MOD_RES (20)..(20): Lys(C12)
  source: /note="C-term amide"
HSQGTFTSDYSKYLDSRRAX

SEQ ID NO: 228 - protein, 19 aa, Artificial Sequence
  source: /note="Description of Artificial Sequence: Synthetic peptide"
  MOD_RES (19)..(19): Lys(C12)
  source: /note="C-term amide"
HSQGTFTSDYSKYLDSRRX

SEQ ID NO: 229 - protein, 18 aa, Artificial Sequence
  source: /note="Description of Artificial Sequence: Synthetic peptide"
  MOD_RES (18)..(18): Lys(C12)
  source: /note="C-term amide"
HSQGTFTSDYSKYLDSRX

SEQ ID NO: 230 - protein, 17 aa, Artificial Sequence
  source: /note="Description of Artificial Sequence: Synthetic peptide"
  MOD_RES (17)..(17): Lys(C12)
  source: /note="C-term amide"
HSQGTFTSDYSKYLDSX

SEQ ID NO: 231 - protein, 16 aa, Artificial Sequence
  source: /note="Description of Artificial Sequence: Synthetic peptide"
  MOD_RES (16)..(16): Lys(C12)
  source: /note="C-term amide"
HSQGTFTSDYSKYLDX

SEQ ID NO: 232 - protein, 21 aa, Artificial Sequence
  source: /note="Description of Artificial Sequence: Synthetic peptide"
  MOD_RES (20)..(20): Lys(C12)
  MOD_RES (21)..(21): Aib
  source: /note="C-term amide"
HAEGTFTSDVSSYLEGQAAXX

SEQ ID NO: 233 - protein, 20 aa, Artificial Sequence
  source: /note="Description of Artificial Sequence: Synthetic peptide"
  MOD_RES (19)..(19): Lys(C12)
  MOD_RES (20)..(20): Aib
  source: /note="C-term amide"
HAEGTFTSDVSSYLEGQAXX

SEQ ID NO: 234 - protein, 19 aa, Artificial Sequence
  source: /note="Description of Artificial Sequence: Synthetic peptide"
  MOD_RES (18)..(18): Lys(C12)
  MOD_RES (19)..(19): Aib
  source: /note="C-term amide"
HAEGTFTSDVSSYLEGQXX

SEQ ID NO: 235 - protein, 18 aa, Artificial Sequence
  source: /note="Description of Artificial Sequence: Synthetic peptide"
  MOD_RES (17)..(17): Lys(C12)
  MOD_RES (18)..(18): Aib
  source: /note="C-term amide"
HAEGTFTSDVSSYLEGXX

SEQ ID NO: 236 - protein, 17 aa, Artificial Sequence
  source: /note="Description of Artificial Sequence: Synthetic peptide"
  MOD_RES (16)..(16): Lys(C12)
  MOD_RES (17)..(17): Aib
  source: /note="C-term amide"
HAEGTFTSDVSSYLEXX

SEQ ID NO: 237 - protein, 16 aa, Artificial Sequence
  source: /note="Description of Artificial Sequence: Synthetic peptide"
  MOD_RES (15)..(15): Lys(C12)
  MOD_RES (16)..(16): Aib
  source: /note="C-term amide"
HAEGTFTSDVSSYLXX

SEQ ID NO: 238 - protein, 17 aa, Artificial Sequence
  source: /note="Description of Artificial Sequence: Synthetic peptide"
  MOD_RES (2)..(2): Aib
  MOD_RES (16)..(16): Lys(C12)
  MOD_RES (17)..(17): Aib
  source: /note="C-term amide"
HXQGTFTSDYSKYLDXX

SEQ ID NO: 239 - protein, 17 aa, Artificial Sequence
  source: /note="Description of Artificial Sequence: Synthetic peptide"
  MOD_RES (2)..(2): Aib
  MOD_RES (16)..(16): Lys(C12)
  MOD_RES (17)..(17): Ac4c
  source: /note="C-term amide"
HXQGTFTSDYSKYLDXX

SEQ ID NO: 240 - protein, 19 aa, Artificial Sequence
  source: /note="Description of Artificial Sequence: Synthetic peptide"
  MOD_RES (2)..(2): Aib
  MOD_RES (16)..(16): Lys(C12)
  MOD_RES (19)..(19): Aib
  source: /note="C-term amide"
HXQGTFTSDYSKYLDXRRX

SEQ ID NO: 241 - protein, 18 aa, Artificial Sequence
  source: /note="Description of Artificial Sequence: Synthetic peptide"
  MOD_RES (2)..(2): Aib
  MOD_RES (16)..(16): Lys(C12)
  MOD_RES (17)..(17): Aib
  source: /note="C-term amide"
HXQGTFTSDYSKYLDXXR

SEQ ID NO: 242 - protein, 18 aa, Artificial Sequence
  source: /note="Description of Artificial Sequence: Synthetic peptide"
  MOD_RES (2)..(2): Aib
  MOD_RES (16)..(16): Lys(C12)
  MOD_RES (18)..(18): Aib
  source: /note="C-term amide"
HXQGTFTSDYSKYLDXRX

SEQ ID NO: 243 - protein, 18 aa, Artificial Sequence
  source: /note="Description of Artificial Sequence: Synthetic peptide"
  MOD_RES (2)..(2): Aib
  MOD_RES (16)..(16): Lys(C12)
  MOD_RES (17)..(17): hArg
  MOD_RES (18)..(18): Aib
  source: /note="C-term amide"
HXQGTFTSDYSKYLDXXX

SEQ ID NO: 244 - protein, 18 aa, Artificial Sequence
  source: /note="Description of Artificial Sequence: Synthetic peptide"
  MOD_RES (2)..(2): Aib
  MOD_RES (17)..(17): Lys(C12)
  MOD_RES (18)..(18): Aib
  source: /note="C-term amide"
HXQGTFTSDYSKYLDSXX

SEQ ID NO: 245 - protein, 18 aa, Artificial Sequence
  source: /note="Description of Artificial Sequence: Synthetic peptide"
  MOD_RES (2)..(2): Aib
  MOD_RES (17)..(17): Lys(C12)
  MOD_RES (18)..(18): Ac4c
  source: /note="C-term amide"
HXQGTFTSDYSKYLDSXX

SEQ ID NO: 246 - protein, 19 aa, Artificial Sequence
  source: /note="Description of Artificial Sequence: Synthetic peptide"
  MOD_RES (2)..(2): Aib
  MOD_RES (17)..(17): Lys(C12)
  MOD_RES (19)..(19): Aib
  source: /note="C-term amide"
HXQGTFTSDYSKYLDSXRX

SEQ ID NO: 247 - protein, 19 aa, Artificial Sequence
  source: /note="Description of Artificial Sequence: Synthetic peptide"
  MOD_RES (2)..(2): Aib
  MOD_RES (17)..(17): Lys(C12)
  MOD_RES (18)..(18): hArg
  MOD_RES (19)..(19): Aib
  source: /note="C-term amide"
HXQGTFTSDYSKYLDSXXX

SEQ ID NO: 248 - protein, 19 aa, Artificial Sequence
  source: /note="Description of Artificial Sequence: Synthetic peptide"
  MOD_RES (2)..(2): Aib
  MOD_RES (18)..(18): Lys(C12)
  MOD_RES (19)..(19): Aib
  source: /note="C-term amide"
HXQGTFTSDYSKYLDSRXX

SEQ ID NO: 249 - protein, 19 aa, Artificial Sequence
  source: /note="Description of Artificial Sequence: Synthetic peptide"
  MOD_RES (2)..(2): Aib
  MOD_RES (18)..(18): Lys(C12)
  MOD_RES (19)..(19): Ac4c
  source: /note="C-term amide"
HXQGTFTSDYSKYLDSRXX

SEQ ID NO: 250 - protein, 19 aa, Artificial Sequence
  source: /note="Description of Artificial Sequence: Synthetic peptide"
  MOD_RES (2)..(2): Aib
  MOD_RES (17)..(17): hArg
  MOD_RES (18)..(18): Lys(C12)
  MOD_RES (19)..(19): Aib
  source: /note="C-term amide"
HXQGTFTSDYSKYLDSXXX

SEQ ID NO: 251 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Lys(C12)
  MOD_RES (19)..(19): Aib
  source: /note="C-term amide"
HXQGTFTSDYSKYLDXRXX

SEQ ID NO: 252 - protein, 19 aa, Artificial Sequence
  source: /note="Description of Artificial Sequence: Synthetic peptide"
  MOD_RES (2)..(2): Aib
  MOD_RES (18)..(18): Lys(C14)
  MOD_RES (19)..(19): Aib
  source: /note="C-term amide"
HXQGTFTSDYSKYLDSRXX

SEQ ID NO: 253 - protein, 19 aa, Artificial Sequence
  source: /note="Description of Artificial Sequence: Synthetic peptide"
  MOD_RES (2)..(2): Aib
  MOD_RES (18)..(18): Lys(C16)
  MOD_RES (19)..(19): Aib
  source: /note="C-term amide"
HXQGTFTSDYSKYLDSRXX

SEQ ID NO: 254 - protein, 19 aa, Artificial Sequence
  source: /note="Description of Artificial Sequence: Synthetic peptide"
  MOD_RES (2)..(2): Aib
  MOD_RES (18)..(18): Lys(C18)
  MOD_RES (19)..(19): Aib
  source: /note="C-term amide"
HXQGTFTSDYSKYLDSRXX

SEQ ID NO: 255 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Lys(C12)
  MOD_RES (19)..(19): Aib
  source: /note="C-term amide"
HXQGTFTSDYSKYLDXQXX

SEQ ID NO: 256 - protein, 20 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (18)..(18): Lys(C12)
  SITE (20)..(20): /note="Lys cyclized through side chain to form a lactam linkage"
  source: /note="C-term amide"
HXQGTFTSDYSKYLDEQXAK

SEQ ID NO: 257 - protein, 20 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (18)..(18): Lys(C14)
  SITE (20)..(20): /note="Lys cyclized through side chain to form a lactam linkage"
  source: /note="C-term amide"
HXQGTFTSDYSKYLDEQXAK

SEQ ID NO: 258 - protein, 20 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (18)..(18): Lys(C16)
  SITE (20)..(20): /note="Lys cyclized through side chain to form a lactam linkage"
  source: /note="C-term amide"
HXQGTFTSDYSKYLDEQXAK

SEQ ID NO: 259 - protein, 20 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (18)..(18): Lys(C18)
  SITE (20)..(20): /note="Lys cyclized through side chain to form a lactam linkage"
  source: /note="C-term amide"
HXQGTFTSDYSKYLDEQXAK

SEQ ID NO: 260 - protein, 20 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (18)..(18): Lys(C20)
  SITE (20)..(20): /note="Lys cyclized through side chain to form a lactam linkage"
  source: /note="C-term amide"
HXQGTFTSDYSKYLDEQXAK

SEQ ID NO: 261 - protein, 20 aa, Artificial Sequence
  source: /note="Description of Artificial Sequence: Synthetic peptide"
  MOD_RES (2)..(2): Aib
  MOD_RES (18)..(18): Lys(C12)
  MOD_RES (19)..(20): Aib
  source: /note="C-term amide"
HXQGTFTSDYSKYLDSRXXX

SEQ ID NO: 262 - protein, 20 aa, Artificial Sequence
  source: /note="Description of Artificial Sequence: Synthetic peptide"
  MOD_RES (2)..(2): Aib
  MOD_RES (18)..(18): Lys(C14)
  MOD_RES (19)..(20): Aib
  source: /note="C-term amide"
HXQGTFTSDYSKYLDSRXXX

SEQ ID NO: 263 - protein, 20 aa, Artificial Sequence
  source: /note="Description of Artificial Sequence: Synthetic peptide"
  MOD_RES (2)..(2): Aib
  MOD_RES (18)..(18): Lys(C16)
  MOD_RES (19)..(20): Aib
  source: /note="C-term amide"
HXQGTFTSDYSKYLDSRXXX

SEQ ID NO: 264 - protein, 20 aa, Artificial Sequence
  source: /note="Description of Artificial Sequence: Synthetic peptide"
  MOD_RES (2)..(2): Aib
  MOD_RES (18)..(18): Lys(C18)
  MOD_RES (19)..(20): Aib
  source: /note="C-term amide"
HXQGTFTSDYSKYLDSRXXX

SEQ ID NO: 265 - protein, 20 aa, Artificial Sequence
  source: /note="Description of Artificial Sequence: Synthetic peptide"
  MOD_RES (2)..(2): Aib
  MOD_RES (18)..(18): Lys(C20)
  MOD_RES (19)..(20): Aib
  source: /note="C-term amide"
HXQGTFTSDYSKYLDSRXXX

SEQ ID NO: 266 - skipped

SEQ ID NO: 267 - protein, 18 aa, Artificial Sequence
  source: /note="Description of Artificial Sequence: Synthetic peptide"
  MOD_RES (2)..(2): Aib
  MOD_RES (16)..(17): Aib
  MOD_RES (18)..(18): Lys(C12)
  source: /note="C-term amide"
HXQGTFTSDYSKYLDXXX

SEQ ID NO: 268 - protein, 18 aa, Artificial Sequence
  source: /note="Description of Artificial Sequence: Synthetic peptide"
  MOD_RES (2)..(2): Aib
  MOD_RES (16)..(17): Aib
  MOD_RES (18)..(18): Lys(C14)
  source: /note="C-term amide"
HXQGTFTSDYSKYLDXXX

SEQ ID NO: 269 - protein, 18 aa, Artificial Sequence
  source: /note="Description of Artificial Sequence: Synthetic peptide"
  MOD_RES (2)..(2): Aib
  MOD_RES (16)..(17): Aib
  MOD_RES (18)..(18): Lys(C16)
  source: /note="C-term amide"
HXQGTFTSDYSKYLDXXX

SEQ ID NO: 270 - protein, 18 aa, Artificial Sequence
  source: /note="Description of Artificial Sequence: Synthetic peptide"
  MOD_RES (2)..(2): Aib
  MOD_RES (16)..(17): Aib
  MOD_RES (18)..(18): Lys(C18)
  source: /note="C-term amide"
HXQGTFTSDYSKYLDXXX

SEQ ID NO: 271 - protein, 18 aa, Artificial Sequence
  source: /note="Description of Artificial Sequence: Synthetic peptide"
  MOD_RES (2)..(2): Aib
  MOD_RES (16)..(17): Aib
  MOD_RES (18)..(18): Lys(C20)
  source: /note="C-term amide"
HXQGTFTSDYSKYLDXXX

SEQ ID NO: 272 - protein, 20 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C12)
  MOD_RES (19)..(20): Aib
  source: /note="C-term amide"
HXQGTFTSDYSKYLDSXXXX

SEQ ID NO: 273 - protein, 20 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C14)
  MOD_RES (19)..(20): Aib
  source: /note="C-term amide"
HXQGTFTSDYSKYLDSXXXX

SEQ ID NO: 274 - protein, 20 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C16)
  MOD_RES (19)..(20): Aib
  source: /note="C-term amide"
HXQGTFTSDYSKYLDSXXXX

SEQ ID NO: 275 - protein, 20 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C18)
  MOD_RES (19)..(20): Aib
  source: /note="C-term amide"
HXQGTFTSDYSKYLDSXXXX

SEQ ID NO: 276 - protein, 20 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C20)
  MOD_RES (19)..(20): Aib
  source: /note="C-term amide"
HXQGTFTSDYSKYLDSXXXX

SEQ ID NO: 277 - protein, 20 aa, Artificial Sequence
  source: /note="Description of Artificial Sequence: Synthetic peptide"
  MOD_RES (2)..(2): Aib
  MOD_RES (17)..(17): Aib
  MOD_RES (18)..(18): Lys(C22)
  MOD_RES (19)..(20): Aib
  source: /note="C-term amide"
HXQGTFTSDYSKYLDSXXXX

SEQ ID NO: 278 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C12)
  MOD_RES (19)..(19): Aib
  source: /note="C-term amide"
HXQGTFTSDYSKYLDERXX

SEQ ID NO: 279 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C14)
  MOD_RES (19)..(19): Aib
  source: /note="C-term amide"
HXQGTFTSDYSKYLDERXX

SEQ ID NO: 280 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C16)
  MOD_RES (19)..(19): Aib
  source: /note="C-term amide"
HXQGTFTSDYSKYLDERXX

SEQ ID NO: 281 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C18)
  MOD_RES (19)..(19): Aib
  source: /note="C-term amide"
HXQGTFTSDYSKYLDERXX

SEQ ID NO: 282 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C20)
  MOD_RES (19)..(19): Aib
  source: /note="C-term amide"
HXQGTFTSDYSKYLDERXX

SEQ ID NO: 283 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C12)
  MOD_RES (19)..(19): Aib
  source: /note="C-term amide"
HXQGTFTSDYSKYLDEQXX

SEQ ID NO: 284 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(16): /note="Glu cyclized through side chain to form a lactam linkage"
  MOD_RES (18)..(18): Lys(C14)
  MOD_RES (19)..(19): Aib
  source: /note="C-term amide"
HXQGTFTSDYSKYLDEQXX

SEQ ID NO: 285 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C16)
  MOD_RES (19)..(19): Aib
  source: /note="C-term amide"
HXQGTFTSDYSKYLDEQXX

SEQ ID NO: 286 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C18)
  MOD_RES (19)..(19): Aib
  source: /note="C-term amide"
HXQGTFTSDYSKYLDEQXX

SEQ ID NO: 287 - protein, 19 aa, Artificial Sequence
  source: /note="Description of Artificial Sequence: Synthetic peptide"
  MOD_RES (2)..(2): Aib
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C20)
  MOD_RES (19)..(19): Aib
  source: /note="C-term amide"
HXQGTFTSDYSKYLDEQXX

SEQ ID NO: 288 - protein, 20 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Lys(C12)
  MOD_RES (19)..(20): Aib
  source: /note="C-term amide"
HXQGTFTSDYSEYLDKRXXX

SEQ ID NO: 289 - protein, 20 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Lys(C14)
  MOD_RES (19)..(20): Aib
  source: /note="C-term amide"
HXQGTFTSDYSEYLDKRXXX

SEQ ID NO: 290 - protein, 20 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Lys(C16)
  MOD_RES (19)..(20): Aib
  source: /note="C-term amide"
HXQGTFTSDYSEYLDKRXXX

SEQ ID NO: 291 - protein, 20 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Lys(C18)
  MOD_RES (19)..(20): Aib
  source: /note="C-term amide"
HXQGTFTSDYSEYLDKRXXX

SEQ ID NO: 292 - protein, 20 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Lys(C20)
  MOD_RES (19)..(20): Aib
  source: /note="C-term amide"
HXQGTFTSDYSEYLDKRXXX

SEQ ID NO: 293 - protein, 20 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (17)..(17): hArg
  MOD_RES (18)..(18): Lys(C12)
  MOD_RES (19)..(20): Aib
  source: /note="C-term amide"
HXQGTFTSDYSEYLDKXXXX

SEQ ID NO: 294 - protein, 20 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (17)..(17): hArg
  MOD_RES (18)..(18): Lys(C14)
  MOD_RES (19)..(20): Aib
  source: /note="C-term amide"
HXQGTFTSDYSEYLDKXXXX

SEQ ID NO: 295 - protein, 20 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (17)..(17): hArg
  MOD_RES (18)..(18): Lys(C16)
  MOD_RES (19)..(20): Aib
  source: /note="C-term amide"
HXQGTFTSDYSEYLDKXXXX

SEQ ID NO: 296 - protein, 20 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (17)..(17): hArg
  MOD_RES (18)..(18): Lys(C18)
  MOD_RES (19)..(20): Aib
  source: /note="C-term amide"
HXQGTFTSDYSEYLDKXXXX

SEQ ID NO: 297 - protein, 20 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (17)..(17): hArg
  MOD_RES (18)..(18): Lys(C20)
  MOD_RES (19)..(20): Aib
  source: /note="C-term amide"
HXQGTFTSDYSEYLDKXXXX

SEQ ID NO: 298 - protein, 20 aa, Artificial Sequence
  source: /note="Description of Artificial Sequence: Synthetic peptide"
  MOD_RES (2)..(2): Ac4c
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C12)
  MOD_RES (19)..(20): Aib
  source: /note="C-term amide"
HXQGTFTSDYSKYLDERXXX

SEQ ID NO: 299 - protein, 20 aa, Artificial Sequence
  source: /note="Description of Artificial Sequence: Synthetic peptide"
  MOD_RES (2)..(2): Ac4c
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C14)
  MOD_RES (19)..(20): Aib
  source: /note="C-term amide"
HXQGTFTSDYSKYLDERXXX

SEQ ID NO: 300 - protein, 20 aa, Artificial Sequence
  source: /note="Description of Artificial Sequence: Synthetic peptide"
  MOD_RES (2)..(2): Ac4c
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C16)
  MOD_RES (19)..(20): Aib
  source: /note="C-term amide"
HXQGTFTSDYSKYLDERXXX

SEQ ID NO: 301 - protein, 20 aa, Artificial Sequence
  source: /note="Description of Artificial Sequence: Synthetic peptide"
  MOD_RES (2)..(2): Ac4c
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C18)
  MOD_RES (19)..(20): Aib
  source: /note="C-term amide"
HXQGTFTSDYSKYLDERXXX

SEQ ID NO: 302 - protein, 20 aa, Artificial Sequence
  source: /note="Description of Artificial Sequence: Synthetic peptide"
  MOD_RES (2)..(2): Ac4c
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (18)..(18): Lys(C20)
  MOD_RES (19)..(20): Aib
  source: /note="C-term amide"
HXQGTFTSDYSKYLDERXXX

SEQ ID NO: 303 - protein, 20 aa, Artificial Sequence
  source: /note="Description of Artificial Sequence: Synthetic peptide"
  MOD_RES (2)..(2): Ac4c
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (17)..(17): hArg
  MOD_RES (18)..(18): Lys(C12)
  MOD_RES (19)..(20): Aib
  source: /note="C-term amide"
HXQGTFTSDYSKYLDEXXXX

SEQ ID NO: 304 - protein, 20 aa, Artificial Sequence
  source: /note="Description of Artificial Sequence: Synthetic peptide"
  MOD_RES (2)..(2): Ac4c
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (17)..(17): hArg
  MOD_RES (18)..(18): Lys(C14)
  MOD_RES (19)..(20): Aib
  source: /note="C-term amide"
HXQGTFTSDYSKYLDEXXXX

SEQ ID NO: 305 - protein, 20 aa, Artificial Sequence
  source: /note="Description of Artificial Sequence: Synthetic peptide"
  MOD_RES (2)..(2): Ac4c
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (17)..(17): hArg
  MOD_RES (18)..(18): Lys(C16)
  MOD_RES (19)..(20): Aib
  source: /note="C-term amide"
HXQGTFTSDYSKYLDEXXXX

SEQ ID NO: 306 - protein, 20 aa, Artificial Sequence
  source: /note="Description of Artificial Sequence: Synthetic peptide"
  MOD_RES (2)..(2): Ac4c
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (17)..(17): hArg
  MOD_RES (18)..(18): Lys(C18)
  MOD_RES (19)..(20): Aib
  source: /note="C-term amide"
HXQGTFTSDYSKYLDEXXXX

SEQ ID NO: 307 - protein, 20 aa, Artificial Sequence
  source: /note="Description of Artificial Sequence: Synthetic peptide"
  MOD_RES (2)..(2): Ac4c
  SITE (12)..(12): /note="Lys cyclized through side chain to form a lactam linkage"
  SITE (16)..(20): /note="Cyclic"
  SITE (16)..(16): /note="Glu cyclized through side chain to form a lactam linkage"
  MOD_RES (17)..(17): hArg
  MOD_RES (18)..(18): Lys(C20)
  MOD_RES (19)..(20): Aib
  source: /note="C-term amide"
HXQGTFTSDYSKYLDEXXXX

SEQ ID NO: 308 - protein, 20 aa, Artificial Sequence
  source: /note="Description of Artificial Sequence: Synthetic peptide"
  MOD_RES (2)..(2): Ac4c
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Lys(C12)
  MOD_RES (19)..(20): Aib
  source: /note="C-term amide"
HXQGTFTSDYSEYLDKRXXX

SEQ ID NO: 309 - protein, 20 aa, Artificial Sequence
  source: /note="Description of Artificial Sequence: Synthetic peptide"
  MOD_RES (2)..(2): Ac4c
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Lys(C14)
  MOD_RES (19)..(20): Aib
  source: /note="C-term amide"
HXQGTFTSDYSEYLDKRXXX

SEQ ID NO: 310 - protein, 20 aa, Artificial Sequence
  source: /note="Description of Artificial Sequence: Synthetic peptide"
  MOD_RES (2)..(2): Ac4c
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Lys(C16)
  MOD_RES (19)..(20): Aib
  source: /note="C-term amide"
HXQGTFTSDYSEYLDKRXXX

SEQ ID NO: 311 - protein, 20 aa, Artificial Sequence
  source: /note="Description of Artificial Sequence: Synthetic peptide"
  MOD_RES (2)..(2): Ac4c
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Lys(C18)
  MOD_RES (19)..(20): Aib
  source: /note="C-term amide"
HXQGTFTSDYSEYLDKRXXX

SEQ ID NO: 312 - protein, 20 aa, Artificial Sequence
  source: /note="Description of Artificial Sequence: Synthetic peptide"
  MOD_RES (2)..(2): Ac4c
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (18)..(18): Lys(C20)
  MOD_RES (19)..(20): Aib
  source: /note="C-term amide"
HXQGTFTSDYSEYLDKRXXX

SEQ ID NO: 313 - protein, 20 aa, Artificial Sequence
  source: /note="Description of Artificial Sequence: Synthetic peptide"
  MOD_RES (2)..(2): Ac4c
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (17)..(17): hArg
  MOD_RES (18)..(18): Lys(C12)
  MOD_RES (19)..(20): Aib
  source: /note="C-term amide"
HXQGTFTSDYSEYLDKXXXX

SEQ ID NO: 314 - protein, 20 aa, Artificial Sequence
  source: /note="Description of Artificial Sequence: Synthetic peptide"
  MOD_RES (2)..(2): Ac4c
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (17)..(17): hArg
  MOD_RES (18)..(18): Lys(C14)
  MOD_RES (19)..(20): Aib
  source: /note="C-term amide"
HXQGTFTSDYSEYLDKXXXX

SEQ ID NO: 315 - protein, 20 aa, Artificial Sequence
  source: /note="Description of Artificial Sequence: Synthetic peptide"
  MOD_RES (2)..(2): Ac4c
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (17)..(17): hArg
  MOD_RES (18)..(18): Lys(C16)
  MOD_RES (19)..(20): Aib
  source: /note="C-term amide"
HXQGTFTSDYSEYLDKXXXX

SEQ ID NO: 316 - protein, 20 aa, Artificial Sequence
  source: /note="Description of Artificial Sequence: Synthetic peptide"
  MOD_RES (2)..(2): Ac4c
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (17)..(17): hArg
  MOD_RES (18)..(18): Lys(C18)
  MOD_RES (19)..(20): Aib
  source: /note="C-term amide"
HXQGTFTSDYSEYLDKXXXX

SEQ ID NO: 317 - protein, 20 aa, Artificial Sequence
  source: /note="Description of Artificial Sequence: Synthetic peptide"
  MOD_RES (2)..(2): Ac4c
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (17)..(17): hArg
  MOD_RES (18)..(18): Lys(C20)
  MOD_RES (19)..(20): Aib
  source: /note="C-term amide"
HXQGTFTSDYSEYLDKXXXX

SEQ ID NO: 318 - protein, 20 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Lys(C12)
  MOD_RES (19)..(19): Aib
  MOD_RES (20)..(20): Aib
  source: /note="C-term amide"
HXQGTFTSDYSKYLDXRXXX

SEQ ID NO: 319 - protein, 20 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Lys(C14)
  MOD_RES (19)..(19): Aib
  MOD_RES (20)..(20): Aib
  source: /note="C-term amide"
HXQGTFTSDYSKYLDXRXXX

SEQ ID NO: 320 - protein, 20 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Lys(C16)
  MOD_RES (19)..(19): Aib
  MOD_RES (20)..(20): Aib
  source: /note="C-term amide"
HXQGTFTSDYSKYLDXRXXX

SEQ ID NO: 321 - protein, 20 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Lys(C18)
  MOD_RES (19)..(19): Aib
  MOD_RES (20)..(20): Aib
  source: /note="C-term amide"
HXQGTFTSDYSKYLDXRXXX

SEQ ID NO: 322 - protein, 20 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Lys(C20)
  MOD_RES (19)..(19): Aib
  MOD_RES (20)..(20): Aib
  source: /note="C-term amide"
HXQGTFTSDYSKYLDXRXXX

SEQ ID NO: 323 - protein, 20 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): hArg
  MOD_RES (18)..(18): Lys(C12)
  MOD_RES (19)..(19): Aib
  MOD_RES (20)..(20): Aib
  source: /note="C-term amide"
HXQGTFTSDYSKYLDXXXXX

SEQ ID NO: 324 - protein, 20 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): hArg
  MOD_RES (18)..(18): Lys(C14)
  MOD_RES (19)..(19): Aib
  MOD_RES (20)..(20): Aib
  source: /note="C-term amide"
HXQGTFTSDYSKYLDXXXXX

SEQ ID NO: 325 - protein, 20 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): hArg
  MOD_RES (18)..(18): Lys(C16)
  MOD_RES (19)..(19): Aib
  MOD_RES (20)..(20): Aib
  source: /note="C-term amide"
HXQGTFTSDYSKYLDXXXXX

SEQ ID NO: 326 - protein, 20 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): hArg
  MOD_RES (18)..(18): Lys(C18)
  MOD_RES (19)..(19): Aib
  MOD_RES (20)..(20): Aib
  source: /note="C-term amide"
HXQGTFTSDYSKYLDXXXXX

SEQ ID NO: 327 - protein, 20 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): hArg
  MOD_RES (18)..(18): Lys(C20)
  MOD_RES (19)..(19): Aib
  MOD_RES (20)..(20): Aib
  source: /note="C-term amide"
HXQGTFTSDYSKYLDXXXXX

SEQ ID NO: 328 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Lys(C12)
  MOD_RES (19)..(19): Aib
  source: /note="C-term amide"
HXQGTFTSDYSKYLDXRXX

SEQ ID NO: 329 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Lys(C14)
  MOD_RES (19)..(19): Aib
  source: /note="C-term amide"
HXQGTFTSDYSKYLDXRXX

SEQ ID NO: 330 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Lys(C16)
  MOD_RES (19)..(19): Aib
  source: /note="C-term amide"
HXQGTFTSDYSKYLDXRXX

SEQ ID NO: 331 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Lys(C18)
  MOD_RES (19)..(19): Aib
  source: /note="C-term amide"
HXQGTFTSDYSKYLDXRXX

SEQ ID NO: 332 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Lys(C20)
  MOD_RES (19)..(19): Aib
  source: /note="C-term amide"
HXQGTFTSDYSKYLDXRXX

SEQ ID NO: 333 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): hArg
  MOD_RES (18)..(18): Lys(C12)
  MOD_RES (19)..(19): Aib
  source: /note="C-term amide"
HXQGTFTSDYSKYLDXXXX

SEQ ID NO: 334 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): hArg
  MOD_RES (18)..(18): Lys(C14)
  MOD_RES (19)..(19): Aib
  source: /note="C-term amide"
HXQGTFTSDYSKYLDXXXX

SEQ ID NO: 335 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): hArg
  MOD_RES (18)..(18): Lys(C16)
  MOD_RES (19)..(19): Aib
  source: /note="C-term amide"
HXQGTFTSDYSKYLDXXXX

SEQ ID NO: 336 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): hArg
  MOD_RES (18)..(18): Lys(C18)
  MOD_RES (19)..(19): Aib
  source: /note="C-term amide"
HXQGTFTSDYSKYLDXXXX

SEQ ID NO: 337 - protein, 19 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): hArg
  MOD_RES (18)..(18): Lys(C20)
  MOD_RES (19)..(19): Aib
  source: /note="C-term amide"
HXQGTFTSDYSKYLDXXXX

SEQ ID NO: 338 - protein, 19 aa, Artificial Sequence
  source: /note="Description of Artificial Sequence: Synthetic peptide"
  MOD_RES (2)..(2): Ac3c
  MOD_RES (16)..(16): Aib
  MOD_RES (17)..(17): hArg
  MOD_RES (18)..(18): Lys(C12)
  MOD_RES (19)..(19): Aib
  source: /note="C-term amide"
HXQGTFTSDYSKYLDXXXX

SEQ ID NO: 339 - protein, 18 aa, Artificial Sequence
  source: /note="Description of Artificial Sequence: Synthetic peptide"
  MOD_RES (2)..(2): Aib
  MOD_RES (18)..(18): Lys(C12)
  source: /note="C-term amide"
HXQGTFTSDYSKYLDSRX

SEQ ID NO: 340 - protein, 18 aa, Artificial Sequence
  source: /note="Description of Artificial Sequence: Synthetic peptide"
  MOD_RES (2)..(2): Aib
  MOD_RES (17)..(17): hArg
  MOD_RES (18)..(18): Lys(C12)
  source: /note="C-term amide"
HXQGTFTSDYSKYLDSXX

SEQ ID NO: 341 - protein, 18 aa, Artificial Sequence
  source: /note="Description of Artificial Sequence: Synthetic peptide"
  MOD_RES (2)..(2): Aib
  MOD_RES (16)..(16): Aib
  MOD_RES (18)..(18): Lys(C12)
  source: /note="C-term amide"
HXQGTFTSDYSKYLDXRX

SEQ ID NO: 342 - protein, 18 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): hArg
  MOD_RES (18)..(18): Lys(C12)
  source: /note="C-term amide"
HXQGTFTSDYSKYLDXXX

SEQ ID NO: 343 - protein, 18 aa, Artificial Sequence
  source: /note="Description of Artificial Sequence: Synthetic peptide"
  MOD_RES (2)..(2): Ac4c
  MOD_RES (16)..(16): Aib
  MOD_RES (18)..(18): Lys(C12)
  source: /note="C-term amide"
HXQGTFTSDYSKYLDXRX

SEQ ID NO: 344 - protein, 19 aa, Artificial Sequence
  source: /note="Description of Artificial Sequence: Synthetic peptide"
  MOD_RES (2)..(2): Ac4c
  MOD_RES (16)..(16): Aib
  MOD_RES (18)..(18): Lys(C12)
  MOD_RES (19)..(19): Aib
  source: /note="C-term amide"
HXQGTFTSDYSKYLDXRXX

SEQ ID NO: 345 - protein, 18 aa, Artificial Sequence
  source: /note="Description of Artificial Sequence: Synthetic peptide"
  MOD_RES (2)..(2): Ac4c
  MOD_RES (16)..(16): Aib
  MOD_RES (17)..(17): hArg
  MOD_RES (18)..(18): Lys(C12)
  source: /note="C-term amide"
HXQGTFTSDYSKYLDXXX

SEQ ID NO: 346 - protein, 18 aa, Artificial Sequence
  source: /note="Description of Artificial Sequence: Synthetic peptide"
  MOD_RES (2)..(2): Ac4c
  MOD_RES (16)..(16): Aib
  MOD_RES (17)..(17): hArg
  MOD_RES (18)..(18): Lys(C14)
  source: /note="C-term amide"
HXQGTFTSDYSKYLDXXX

SEQ ID NO: 347 - protein, 18 aa, Artificial Sequence
  source: /note="Description of Artificial Sequence: Synthetic peptide"
  MOD_RES (2)..(2): Ac4c
  MOD_RES (16)..(16): Aib
  MOD_RES (17)..(17): hArg
  MOD_RES (18)..(18): Lys(C16)
  source: /note="C-term amide"
HXQGTFTSDYSKYLDXXX

SEQ ID NO: 348 - protein, 18 aa, Artificial Sequence
  source: /note="Description of Artificial Sequence: Synthetic peptide"
  MOD_RES (2)..(2): Ac4c
  MOD_RES (16)..(16): Aib
  MOD_RES (17)..(17): hArg
  MOD_RES (18)..(18): Lys(C18)
  source: /note="C-term amide"
HXQGTFTSDYSKYLDXXX

SEQ ID NO: 349 - protein, 18 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (18)..(18): Lys(C12)
  source: /note="C-term amide"
HXQGTFTSDESKYKDSRX

SEQ ID NO: 350 - protein, 18 aa, Artificial Sequence
  source: /note="Description of Artificial Sequence: Synthetic peptide"
  MOD_RES (2)..(2): Ac4c
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (16)..(16): Aib
  MOD_RES (17)..(17): hArg
  MOD_RES (18)..(18): Lys(C14)
  source: /note="C-term amide"
HXQGTFTSDESKYKDXXX

SEQ ID NO: 351 - protein, 18 aa, Artificial Sequence
  source: /note="Description of Artificial Sequence: Synthetic peptide"
  MOD_RES (2)..(2): Aib
  SITE (13)..(17): /note="Cyclic"
  SITE (13)..(13): /note="Glu cyclized through side chain to form a lactam linkage"
  SITE (17)..(17): /note="Lys cyclized through side chain to form a lactam linkage"
  MOD_RES (18)..(18): Lys(C12)
  source: /note="C-term amide"
HXQGTFTSDYSKELDSKX

SEQ ID NO: 352 - protein, 20 aa, Artificial Sequence
  source: /note="Description of Artificial Sequence: Synthetic peptide"
  MOD_RES (2)..(2): Aib
  SITE (17)..(20): /note="Cyclic"
  SITE (17)..(17): /note="Glu cyclized through side chain to form a lactam linkage"
  MOD_RES (18)..(18): Lys(C12)
  SITE (20)..(20): /note="Lys cyclized through side chain to form a lactam linkage"
  source: /note="C-term amide"
HXQGTFTSDYSKYLDSEXAK

SEQ ID NO: 353 - protein, 21 aa, Artificial Sequence
  source: /note="Description of Artificial Sequence: Synthetic peptide"
  MOD_RES (2)..(2): Aib
  SITE (17)..(21): /note="Cyclic"
  SITE (17)..(17): /note="Glu cyclized through side chain to form a lactam linkage"
  MOD_RES (18)..(18): Lys(C12)
  SITE (21)..(21): /note="Lys cyclized through side chain to form a lactam linkage"
  source: /note="C-term amide"
HXQGTFTSDYSKYLDSEXARK

SEQ ID NO: 354 - protein, 21 aa, Artificial Sequence
  source: /note="Description of Artificial Sequence: Synthetic peptide"
  MOD_RES (2)..(2): Aib
  SITE (17)..(21): /note="Cyclic"
  SITE (17)..(17): /note="Glu cyclized through side chain to form a lactam linkage"
  MOD_RES (18)..(18): Lys(C14)
  SITE (21)..(21): /note="Lys cyclized through side chain to form a lactam linkage"
  source: /note="C-term amide"
HXQGTFTSDYSKYLDSEXARK

SEQ ID NO: 355 - protein, 21 aa, Artificial Sequence
  source: /note="Description of Artificial Sequence: Synthetic peptide"
  MOD_RES (2)..(2): Aib
  SITE (17)..(21): /note="Cyclic"
  SITE (17)..(17): /note="Glu cyclized through side chain to form a lactam linkage"
  MOD_RES (18)..(18): Lys(C16)
  SITE (21)..(21): /note="Lys cyclized through side chain to form a lactam linkage"
  source: /note="C-term amide"
HXQGTFTSDYSKYLDSEXARK

SEQ ID NO: 356 - protein, 21 aa, Artificial Sequence
  source: /note="Description of Artificial Sequence: Synthetic peptide"
  MOD_RES (2)..(2): Aib
  SITE (17)..(21): /note="Cyclic"
  SITE (17)..(17): /note="Glu cyclized through side chain to form a lactam linkage"
  MOD_RES (18)..(18): Lys(C18)
  SITE (21)..(21): /note="Lys cyclized through side chain to form a lactam linkage"
  source: /note="C-term amide"
HXQGTFTSDYSKYLDSEXARK

SEQ ID NO: 357 - protein, 21 aa, Artificial Sequence
  source: /note="Description of Artificial Sequence: Synthetic peptide"
  MOD_RES (2)..(2): Aib
  SITE (17)..(21): /note="Cyclic"
  SITE (17)..(17): /note="Glu cyclized through side chain to form a lactam linkage"
  MOD_RES (18)..(18): Lys(C20)
  SITE (21)..(21): /note="Lys cyclized through side chain to form a lactam linkage"
  source: /note="C-term amide"
HXQGTFTSDYSKYLDSEXARK

SEQ ID NO: 358 - protein, 21 aa, Artificial Sequence
  source: /note="Description of Artificial Sequence: Synthetic peptide"
  MOD_RES (2)..(2): Aib
  SITE (17)..(21): /note="Cyclic"
  SITE (17)..(17): /note="Glu cyclized through side chain to form a lactam linkage"
  MOD_RES (18)..(18): Lys(C12)
  SITE (21)..(21): /note="Lys cyclized through side chain to form a lactam linkage"
  source: /note="C-term amide"
HXQGTFTSDYSKYLDSEXAQK

SEQ ID NO: 359 - protein, 21 aa, Artificial Sequence
  source: /note="Description of Artificial Sequence: Synthetic peptide"
  MOD_RES (2)..(2): Aib
  SITE (17)..(21): /note="Cyclic"
  SITE (17)..(17): /note="Glu cyclized through side chain to form a lactam linkage"
  MOD_RES (18)..(18): Lys(C14)
  SITE (21)..(21): /note="Lys cyclized through side chain to form a lactam linkage"
  source: /note="C-term amide"
HXQGTFTSDYSKYLDSEXAQK

SEQ ID NO: 360 - protein, 21 aa, Artificial Sequence
  source: /note="Description of Artificial Sequence: Synthetic peptide"
  MOD_RES (2)..(2): Aib
  SITE (17)..(21): /note="Cyclic"
  SITE (17)..(17): /note="Glu cyclized through side chain to form a lactam linkage"
  MOD_RES (18)..(18): Lys(C16)
  SITE (21)..(21): /note="Lys cyclized through side chain to form a lactam linkage"
  source: /note="C-term amide"
HXQGTFTSDYSKYLDSEXAQK

SEQ ID NO: 361 - protein, 21 aa, Artificial Sequence
  source: /note="Description of Artificial Sequence: Synthetic peptide"
  MOD_RES (2)..(2): Aib
  SITE (17)..(21): /note="Cyclic"
  SITE (17)..(17): /note="Glu cyclized through side chain to form a lactam linkage"
  MOD_RES (18)..(18): Lys(C18)
  SITE (21)..(21): /note="Lys cyclized through side chain to form a lactam linkage"
  source: /note="C-term amide"
HXQGTFTSDYSKYLDSEXAQK

SEQ ID NO: 362 - protein, 21 aa, Artificial Sequence
  source: /note="Description of Artificial Sequence: Synthetic peptide"
  MOD_RES (2)..(2): Aib
  SITE (17)..(21): /note="Cyclic"
  SITE (17)..(17): /note="Glu cyclized through side chain to form a lactam linkage"
  MOD_RES (18)..(18): Lys(C20)
  SITE (21)..(21): /note="Lys cyclized through side chain to form a lactam linkage"
  source: /note="C-term amide"
HXQGTFTSDYSKYLDSEXAQK

SEQ ID NO: 363 - protein, 21 aa, Artificial Sequence
  source: /note="Description of Artificial Sequence: Synthetic peptide"
  MOD_RES (2)..(2): Aib
  SITE (17)..(21): /note="Cyclic"
  SITE (17)..(17): /note="Glu cyclized through side chain to form a lactam linkage"
  MOD_RES (18)..(18): Lys(C12)
  SITE (21)..(21): /note="Lys cyclized through side chain to form a lactam linkage"
  source: /note="C-term amide"
HXQGTFTSDYSKYLDSEXVRK

SEQ ID NO: 364 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (11)..(11): Lys(C8)
  source: /note="C-term amide"
HXQGTXTSDYX

SEQ ID NO: 365 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (11)..(11): Lys(C14)
  source: /note="C-term amide"
HXQGTXTSDYX

SEQ ID NO: 366 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (11)..(11): Lys(C16)
  source: /note="C-term amide"
HXQGTXTSDYX

SEQ ID NO: 367 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (11)..(11): Lys(C20)
  source: /note="C-term amide"
HXQGTXTSDYX

SEQ ID NO: 368 - protein, 11 aa, Artificial Sequence
  source: /note="Description of Artificial Sequence: Synthetic peptide"
  MOD_RES (2)..(2): Aib
  MOD_RES (11)..(11): Lys(C12)
  source: /note="C-term amide"
HXQGTFTSDYX

SEQ ID NO: 369 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (11)..(11): Lys(C12)
  source: /note="C-term amide"
HXQGTXTSDYX

SEQ ID NO: 370 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (11)..(11): Lys(C18)
  source: /note="C-term amide"
HXQGTXTSDYX

SEQ ID NO: 371 - protein, 11 aa, Artificial Sequence
  source: /note="Description of Artificial Sequence: Synthetic peptide"
  MOD_RES (2)..(2): Alpha-MePro
  MOD_RES (11)..(11): Lys(C12)
  source: /note="C-term amide"
HXQGTFTSDYX

SEQ ID NO: 372 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (11)..(11): Lys(C12)
  source: /note="C-term amide"
HXQGTXTSDYX

SEQ ID NO: 373 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): Lys(C12)
  source: /note="C-term amide"
HXQGTXTSDXX

SEQ ID NO: 374 - protein, 11 aa, Artificial Sequence
  source: /note="Description of Artificial Sequence: Synthetic peptide"
  MOD_RES (2)..(2): Aib
  MOD_RES (10)..(10): Bip
  MOD_RES (11)..(11): Lys(C12)
  source: /note="C-term amide"
HXQGTFTSDXX

SEQ ID NO: 375 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): Lys(C18)
  source: /note="C-term amide"
HXQGTXTSDXX

SEQ ID NO: 376 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (11)..(11): Lys(C8)
  source: /note="C-term amide"
HXQGTXTSDYX

SEQ ID NO: 377 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (11)..(11): Lys(16)
  source: /note="C-term amide"
HXQGTXTSDYX

SEQ ID NO: 378 - protein, 29 aa, Artificial Sequence
  source: /note="Description of Artificial Sequence: Synthetic peptide"
  MOD_RES (17)..(17): Lys(C8)
  source: /note="C-term amide"
HGQGTFTSDYSKYLDEXAAREFIAWLLNT

SEQ ID NO: 379 - protein, 29 aa, Artificial Sequence
  source: /note="Description of Artificial Sequence: Synthetic peptide"
  MOD_RES (17)..(17): Lys(C12)
  source: /note="C-term amide"
HGQGTFTSDYSKYLDEXAAREFIAWLLNT

SEQ ID NO: 380 - protein, 29 aa, Artificial Sequence
  source: /note="Description of Artificial Sequence: Synthetic peptide"
  MOD_RES (17)..(17): Lys(C14)
  source: /note="C-term amide"
HGQGTFTSDYSKYLDEXAAREFIAWLLNT

SEQ ID NO: 381 - protein, 29 aa, Artificial Sequence
  source: /note="Description of Artificial Sequence: Synthetic peptide"
  MOD_RES (17)..(17): Lys(C16)
  source: /note="C-term amide"
HGQGTFTSDYSKYLDEXAAREFIAWLLNT

SEQ ID NO: 382 - protein, 29 aa, Artificial Sequence
  source: /note="Description of Artificial Sequence: Synthetic peptide"
  MOD_RES (17)..(17): Lys(C18)
  source: /note="C-term amide"
HGQGTFTSDYSKYLDEXAAREFIAWLLNT

SEQ ID NO: 383 - protein, 29 aa, Artificial Sequence
  source: /note="Description of Artificial Sequence: Synthetic peptide"
  MOD_RES (17)..(17): Lys(C20)
  source: /note="C-term amide"
HGQGTFTSDYSKYLDEXAAREFIAWLLNT

SEQ ID NO: 384 - protein, 29 aa, Artificial Sequence
  source: /note="Description of Artificial Sequence: Synthetic peptide"
  MOD_RES (17)..(17): Lys(C8)
  source: /note="C-term amide"
HGQGTFTSDYSKYLDEXAAKEFIAWLLNT

SEQ ID NO: 385 - protein, 29 aa, Artificial Sequence
  source: /note="Description of Artificial Sequence: Synthetic peptide"
  MOD_RES (17)..(17): Lys(C14)
  source: /note="C-term amide"
HGQGTFTSDYSKYLDEXAAKEFIAWLLNT

SEQ ID NO: 386 - protein, 29 aa, Artificial Sequence
  source: /note="Description of Artificial Sequence: Synthetic peptide"
  MOD_RES (17)..(17): Lys(C16)
  source: /note="C-term amide"
HGQGTFTSDYSKYLDEXAAKEFIAWLLNT

SEQ ID NO: 387 - protein, 29 aa, Artificial Sequence
  source: /note="Description of Artificial Sequence: Synthetic peptide"
  MOD_RES (17)..(17): Lys(C20)
  source: /note="C-term amide"
HGQGTFTSDYSKYLDEXAAKEFIAWLLNT

SEQ ID NO: 388 - protein, 29 aa, Artificial Sequence
  source: /note="Description of Artificial Sequence: Synthetic peptide"
  source: /note="C-term amide"
HGQGTFTSDYSKYLDEKAAKEFIAWLLNT

SEQ ID NO: 389 - protein, 29 aa, Artificial Sequence
  source: /note="Description of Artificial Sequence: Synthetic peptide"
  MOD_RES (17)..(17): Lys(C12)
  source: /note="C-term amide"
HGQGTFTSDYSKYLDEXAAKEFIAWLLNT

SEQ ID NO: 390 - protein, 29 aa, Artificial Sequence
  source: /note="Description of Artificial Sequence: Synthetic peptide"
  MOD_RES (17)..(17): Lys(C18)
  source: /note="C-term amide"
HGQGTFTSDYSKYLDEXAAKEFIAWLLNT

SEQ ID NO: 391 - protein, 29 aa, Artificial Sequence
  source: /note="Description of Artificial Sequence: Synthetic peptide"
  MOD_RES (2)..(2): Aib
  MOD_RES (17)..(17): Lys(C18)
  source: /note="C-term amide"
HXQGTFTSDYSKYLDEXAAKEFIAWLLNT

SEQ ID NO: 392 - protein, 29 aa, Artificial Sequence
  source: /note="Description of Artificial Sequence: Synthetic peptide"
  source: /note="C-term amide"
HGQGTFTSDYSKYLDERRAKDFVQWLLNT

SEQ ID NO: 393 - protein, 29 aa, Artificial Sequence
  source: /note="Description of Artificial Sequence: Synthetic peptide"
  MOD_RES (20)..(20): Lys(C12)
  source: /note="C-term amide"
HGQGTFTSDYSKYLDERRAXDFVQWLLNT

SEQ ID NO: 394 - protein, 29 aa, Artificial Sequence
  source: /note="Description of Artificial Sequence: Synthetic peptide"
  MOD_RES (20)..(20): Lys(C18)
  source: /note="C-term amide"
HGQGTFTSDYSKYLDERRAXDFVQWLLNT

SEQ ID NO: 395 - protein, 29 aa, Artificial Sequence
  source: /note="Description of Artificial Sequence: Synthetic peptide"
  MOD_RES (2)..(2): Aib
  MOD_RES (20)..(20): Lys(C18)
  source: /note="C-term amide"
HXQGTFTSDYSKYLDERRAXDFVQWLLNT

SEQ ID NO: 396 - protein, 29 aa, Artificial Sequence
  source: /note="Description of Artificial Sequence: Synthetic peptide"
  MOD_RES (2)..(2): Aib
  MOD_RES (20)..(20): Lys(C8)
  source: /note="C-term amide"
HXQGTFTSDYSKYLDERRAXDFVQWLLNT

SEQ ID NO: 397 - protein, 29 aa, Artificial Sequence
  source: /note="Description of Artificial Sequence: Synthetic peptide"
  MOD_RES (2)..(2): Aib
  MOD_RES (20)..(20): Lys(C12)
  source: /note="C-term amide"
HXQGTFTSDYSKYLDERRAXDFVQWLLNT

SEQ ID NO: 398 - protein, 29 aa, Artificial Sequence
  source: /note="Description of Artificial Sequence: Synthetic peptide"
  MOD_RES (2)..(2): Aib
  MOD_RES (20)..(20): Lys(C14)
  source: /note="C-term amide"
HXQGTFTSDYSKYLDERRAXDFVQWLLNT

SEQ ID NO: 399 - protein, 29 aa, Artificial Sequence
  source: /note="Description of Artificial Sequence: Synthetic peptide"
  MOD_RES (2)..(2): Aib
  MOD_RES (20)..(20): Lys(C16)
  source: /note="C-term amide"
HXQGTFTSDYSKYLDERRAXDFVQWLLNT

SEQ ID NO: 400 - protein, 29 aa, Artificial Sequence
  source: /note="Description of Artificial Sequence: Synthetic peptide"
  MOD_RES (2)..(2): Aib
  MOD_RES (20)..(20): Lys(C18)
  source: /note="C-term amide"
HXQGTFTSDYSKYLDERRAXDFVQWLLNT

SEQ ID NO: 401 - protein, 29 aa, Artificial Sequence
  source: /note="Description of Artificial Sequence: Synthetic peptide"
  MOD_RES (2)..(2): Aib
  MOD_RES (20)..(20): Lys(C20)
  source: /note="C-term amide"
HXQGTFTSDYSKYLDERRAXDFVQWLLNT

SEQ ID NO: 402 - protein, 29 aa, Artificial Sequence
  source: /note="Description of Artificial Sequence: Synthetic peptide"
  MOD_RES (20)..(20): Lys(C8)
  source: /note="C-term amide"
HGQGTFTSDYSKYLDERRAXDFVQWLLNT

SEQ ID NO: 403 - protein, 29 aa, Artificial Sequence
  source: /note="Description of Artificial Sequence: Synthetic peptide"
  MOD_RES (20)..(20): Lys(C12)
  source: /note="C-term amide"
HGQGTFTSDYSKYLDERRAXDFVQWLLNT

SEQ ID NO: 404 - protein, 29 aa, Artificial Sequence
  source: /note="Description of Artificial Sequence: Synthetic peptide"
  MOD_RES (20)..(20): Lys(C14)
  source: /note="C-term amide"
HGQGTFTSDYSKYLDERRAXDFVQWLLNT

SEQ ID NO: 405 - protein, 29 aa, Artificial Sequence
  source: /note="Description of Artificial Sequence: Synthetic peptide"
  MOD_RES (20)..(20): Lys(C16)
  source: /note="C-term amide"
HGQGTFTSDYSKYLDERRAXDFVQWLLNT

SEQ ID NO: 406 - protein, 29 aa, Artificial Sequence
  source: /note="Description of Artificial Sequence: Synthetic peptide"
  MOD_RES (20)..(20): Lys(C18)
  source: /note="C-term amide"
HGQGTFTSDYSKYLDERRAXDFVQWLLNT

SEQ ID NO: 407 - protein, 29 aa, Artificial Sequence
  source: /note="Description of Artificial Sequence: Synthetic peptide"
  MOD_RES (20)..(20): Lys(C20)
  source: /note="C-term amide"
HGQGTFTSDYSKYLDERRAXDFVQWLLNT

SEQ ID NO: 408 - protein, 29 aa, Artificial Sequence
  source: /note="Description of Artificial Sequence: Synthetic peptide"
  MOD_RES (2)..(2): Aib
  MOD_RES (17)..(17): Lys(C8)
  source: /note="C-term amide"
HXQGTFTSDYSKYLDEXAAKEFIAWLLNT

SEQ ID NO: 409 - protein, 29 aa, Artificial Sequence
  source: /note="Description of Artificial Sequence: Synthetic peptide"
  MOD_RES (2)..(2): Aib
  MOD_RES (17)..(17): Lys(C12)
  source: /note="C-term amide"
HXQGTFTSDYSKYLDEXAAKEFIAWLLNT

SEQ ID NO: 410 - protein, 29 aa, Artificial Sequence
  source: /note="Description of Artificial Sequence: Synthetic peptide"
  MOD_RES (2)..(2): Aib
  MOD_RES (17)..(17): Lys(C14)
  source: /note="C-term amide"
HXQGTFTSDYSKYLDEXAAKEFIAWLLNT

SEQ ID NO: 411 - protein, 29 aa, Artificial Sequence
  source: /note="Description of Artificial Sequence: Synthetic peptide"
  MOD_RES (2)..(2): Aib
  MOD_RES (17)..(17): Lys(C16)
  source: /note="C-term amide"
HXQGTFTSDYSKYLDEXAAKEFIAWLLNT

SEQ ID NO: 412 - protein, 29 aa, Artificial Sequence
  source: /note="Description of Artificial Sequence: Synthetic peptide"
  MOD_RES (2)..(2): Aib
  MOD_RES (17)..(17): Lys(C18)
  source: /note="C-term amide"
HXQGTFTSDYSKYLDEXAAKEFIAWLLNT

SEQ ID NO: 413 - protein, 29 aa, Artificial Sequence
  source: /note="Description of Artificial Sequence: Synthetic peptide"
  MOD_RES (2)..(2): Aib
  MOD_RES (17)..(17): Lys(C20)
  source: /note="C-term amide"
HXQGTFTSDYSKYLDEXAAKEFIAWLLNT

SEQ ID NO: 414 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C8)
  source: /note="C-term amide"
HXQGTFTSDYSKYLDEQAAKEFIXWLMNT

SEQ ID NO: 415 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C12)
  source: /note="C-term amide"
HXQGTFTSDYSKYLDEQAAKEFIXWLMNT

SEQ ID NO: 416 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C14)
  source: /note="C-term amide"
HXQGTFTSDYSKYLDEQAAKEFIXWLMNT

SEQ ID NO: 417 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C16)
  source: /note="C-term amide"
HXQGTFTSDYSKYLDEQAAKEFIXWLMNT

SEQ ID NO: 418 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C18)
  source: /note="C-term amide"
HXQGTFTSDYSKYLDEQAAKEFIXWLMNT

SEQ ID NO: 419 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C20)
  source: /note="C-term amide"
HXQGTFTSDYSKYLDEQAAKEFIXWLMNT

SEQ ID NO: 420 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C8)
  source: /note="C-term amide"
HXQGTFTSDYSKYLDEQAAKEFIXWLLNT

SEQ ID NO: 421 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C12)
  source: /note="C-term amide"
HXQGTFTSDYSKYLDEQAAKEFIXWLLNT

SEQ ID NO: 422 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C14)
  source: /note="C-term amide"
HXQGTFTSDYSKYLDEQAAKEFIXWLLNT

SEQ ID NO: 423 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C16)
  source: /note="C-term amide"
HXQGTFTSDYSKYLDEQAAKEFIXWLLNT

SEQ ID NO: 424 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C18)
  source: /note="C-term amide"
HXQGTFTSDYSKYLDEQAAKEFIXWLLNT

SEQ ID NO: 425 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C20)
  source: /note="C-term amide"
HXQGTFTSDYSKYLDEQAAKEFIXWLLNT

SEQ ID NO: 426 - protein, 29 aa, Artificial Sequence
  source: /note="Description of Artificial Sequence: Synthetic peptide"
  MOD_RES (24)..(24): Lys(C8)
  source: /note="C-term amide"
HGQGTFTSDYSKYLDEQAAREFIXWLLNT

SEQ ID NO: 427 - protein, 29 aa, Artificial Sequence
  source: /note="Description of Artificial Sequence: Synthetic peptide"
  MOD_RES (24)..(24): Lys(C12)
  source: /note="C-term amide"
HGQGTFTSDYSKYLDEQAAREFIXWLLNT

SEQ ID NO: 428 - protein, 29 aa, Artificial Sequence
  source: /note="Description of Artificial Sequence: Synthetic peptide"
  MOD_RES (24)..(24): Lys(C14)
  source: /note="C-term amide"
HGQGTFTSDYSKYLDEQAAREFIXWLLNT

SEQ ID NO: 429 - protein, 29 aa, Artificial Sequence
  source: /note="Description of Artificial Sequence: Synthetic peptide"
  MOD_RES (24)..(24): Lys(C16)
  source: /note="C-term amide"
HGQGTFTSDYSKYLDEQAAREFIXWLLNT

SEQ ID NO: 430 - protein, 29 aa, Artificial Sequence
  source: /note="Description of Artificial Sequence: Synthetic peptide"
  MOD_RES (24)..(24): Lys(C18)
  source: /note="C-term amide"
HGQGTFTSDYSKYLDEQAAREFIXWLLNT

SEQ ID NO: 431 - protein, 29 aa, Artificial Sequence
  source: /note="Description of Artificial Sequence: Synthetic peptide"
  MOD_RES (24)..(24): Lys(C20)
  source: /note="C-term amide"
HGQGTFTSDYSKYLDEQAAREFIXWLLNT

SEQ ID NO: 432 - protein, 29 aa, Artificial Sequence
  source: /note="Description of Artificial Sequence: Synthetic peptide"
  MOD_RES (2)..(2): Aib
  MOD_RES (17)..(17): Lys(C8)
  source: /note="C-term amide"
HXQGTFTSDYSKYLDEXAAREFIAWLLNT

SEQ ID NO: 433 - protein, 29 aa, Artificial Sequence
  source: /note="Description of Artificial Sequence: Synthetic peptide"
  MOD_RES (2)..(2): Aib
  MOD_RES (17)..(17): Lys(C12)
  source: /note="C-term amide"
HXQGTFTSDYSKYLDEXAAREFIAWLLNT

SEQ ID NO: 434 - protein, 29 aa, Artificial Sequence
  source: /note="Description of Artificial Sequence: Synthetic peptide"
  MOD_RES (2)..(2): Aib
  MOD_RES (17)..(17): Lys(C14)
  source: /note="C-term amide"
HXQGTFTSDYSKYLDEXAAREFIAWLLNT

SEQ ID NO: 435 - protein, 29 aa, Artificial Sequence
  source: /note="Description of Artificial Sequence: Synthetic peptide"
  MOD_RES (2)..(2): Aib
  MOD_RES (17)..(17): Lys(C16)
  source: /note="C-term amide"
HXQGTFTSDYSKYLDEXAAREFIAWLLNT

SEQ ID NO: 436 - protein, 29 aa, Artificial Sequence
  source: /note="Description of Artificial Sequence: Synthetic peptide"
  MOD_RES (2)..(2): Aib
  MOD_RES (17)..(17): Lys(C18)
  source: /note="C-term amide"
HXQGTFTSDYSKYLDEXAAREFIAWLLNT

SEQ ID NO: 437 - protein, 29 aa, Artificial Sequence
  source: /note="Description of Artificial Sequence: Synthetic peptide"
  MOD_RES (2)..(2): Aib
  MOD_RES (17)..(17): Lys(C20)
  source: /note="C-term amide"
HXQGTFTSDYSKYLDEXAAREFIAWLLNT

SEQ ID NO: 438 - protein, 29 aa, Artificial Sequence
  source: /note="Description of Artificial Sequence: Synthetic peptide"
  MOD_RES (24)..(24): Lys(C8)
  source: /note="C-term amide"
HGQGTFTSDYSKYLDERRAQDFVXWLLNT

SEQ ID NO: 439 - protein, 29 aa, Artificial Sequence
  source: /note="Description of Artificial Sequence: Synthetic peptide"
  MOD_RES (24)..(24): Lys(C12)
  source: /note="C-term amide"
HGQGTFTSDYSKYLDERRAQDFVXWLLNT

SEQ ID NO: 440 - protein, 29 aa, Artificial Sequence
  source: /note="Description of Artificial Sequence: Synthetic peptide"
  MOD_RES (24)..(24): Lys(C14)
  source: /note="C-term amide"
HGQGTFTSDYSKYLDERRAQDFVXWLLNT

SEQ ID NO: 441 - protein, 29 aa, Artificial Sequence
  source: /note="Description of Artificial Sequence: Synthetic peptide"
  MOD_RES (24)..(24): Lys(C16)
  source: /note="C-term amide"
HGQGTFTSDYSKYLDERRAQDFVXWLLNT

SEQ ID NO: 442 - protein, 29 aa, Artificial Sequence
  source: /note="Description of Artificial Sequence: Synthetic peptide"
  MOD_RES (24)..(24): Lys(C18)
  source: /note="C-term amide"
HGQGTFTSDYSKYLDERRAQDFVXWLLNT

SEQ ID NO: 443 - protein, 29 aa, Artificial Sequence
  source: /note="Description of Artificial Sequence: Synthetic peptide"
  MOD_RES (24)..(24): Lys(C20)
  source: /note="C-term amide"
HGQGTFTSDYSKYLDERRAQDFVXWLLNT

SEQ ID NO: 444 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): Lys(C8)
  source: /note="C-term amide"
HXQGTXTSDXX

SEQ ID NO: 445 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): Lys(C12)
  source: /note="C-term amide"
HXQGTXTSDXX

SEQ ID NO: 446 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): Lys(C14)
  source: /note="C-term amide"
HXQGTXTSDXX

SEQ ID NO: 447 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): Lys(C16)
  source: /note="C-term amide"
HXQGTXTSDXX

SEQ ID NO: 448 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): Lys(C18)
  source: /note="C-term amide"
HXQGTXTSDXX

SEQ ID NO: 449 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): Lys(C20)
  source: /note="C-term amide"
HXQGTXTSDXX

SEQ ID NO: 450 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): Lys(C8)
  source: /note="C-term amide"
HXQGTXTSDXX

SEQ ID NO: 451 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): Lys(C12)
  source: /note="C-term amide"
HXQGTXTSDXX

SEQ ID NO: 452 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): Lys(C14)
  source: /note="C-term amide"
HXQGTXTSDXX

SEQ ID NO: 453 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): Lys(C16)
  source: /note="C-term amide"
HXQGTXTSDXX

SEQ ID NO: 454 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): Lys(C18)
  source: /note="C-term amide"
HXQGTXTSDXX

SEQ ID NO: 455 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): Lys(C20)
  source: /note="C-term amide"
HXQGTXTSDXX

SEQ ID NO: 456 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): Lys(C8)
  source: /note="C-term amide"
HXQGTXTSDXX

SEQ ID NO: 457 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): Lys(C12)
  source: /note="C-term amide"
HXQGTXTSDXX

SEQ ID NO: 458 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): Lys(C14)
  source: /note="C-term amide"
HXQGTXTSDXX

SEQ ID NO: 459 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): Lys(C16)
  source: /note="C-term amide"
HXQGTXTSDXX

SEQ ID NO: 460 - protein, 29 aa, Artificial Sequence
  source: /note="Description of Artificial Sequence: Synthetic peptide"
  MOD_RES (17)..(17): Lys(C16)
  source: /note="C-term amide"
HGQGTFTSDYSKYLDAXAAREFIAWLLNT

SEQ ID NO: 461 - protein, 29 aa, Artificial Sequence
  source: /note="Description of Artificial Sequence: Synthetic peptide"
  MOD_RES (17)..(17): Lys(C18)
  source: /note="C-term amide"
HGQGTFTSDYSKYLDAXAAREFIAWLLNT

SEQ ID NO: 462 - protein, 29 aa, Artificial Sequence
  source: /note="Description of Artificial Sequence: Synthetic peptide"
  MOD_RES (17)..(17): Lys(C20)
  source: /note="C-term amide"
HGQGTFTSDYSKYLDAXAAREFIAWLLNT

SEQ ID NO: 463 - protein, 29 aa, Artificial Sequence
  source: /note="Description of Artificial Sequence: Synthetic peptide"
  MOD_RES (17)..(17): Lys(C8)
  source: /note="C-term amide"
HGQGTFTSDYSKYLDAXAAKEFIAWLLNT

SEQ ID NO: 464 - protein, 29 aa, Artificial Sequence
  source: /note="Description of Artificial Sequence: Synthetic peptide"
  MOD_RES (17)..(17): Lys(C12)
  source: /note="C-term amide"
HGQGTFTSDYSKYLDAXAAKEFIAWLLNT

SEQ ID NO: 465 - protein, 29 aa, Artificial Sequence
  source: /note="Description of Artificial Sequence: Synthetic peptide"
  MOD_RES (17)..(17): Lys(C14)
  source: /note="C-term amide"
HGQGTFTSDYSKYLDAXAAKEFIAWLLNT

SEQ ID NO: 466 - protein, 29 aa, Artificial Sequence
  source: /note="Description of Artificial Sequence: Synthetic peptide"
  MOD_RES (17)..(17): Lys(C16)
  source: /note="C-term amide"
HGQGTFTSDYSKYLDAXAAKEFIAWLLNT

SEQ ID NO: 467 - protein, 29 aa, Artificial Sequence
  source: /note="Description of Artificial Sequence: Synthetic peptide"
  MOD_RES (17)..(17): Lys(C18)
  source: /note="C-term amide"
HGQGTFTSDYSKYLDAXAAKEFIAWLLNT

SEQ ID NO: 468 - protein, 29 aa, Artificial Sequence
  source: /note="Description of Artificial Sequence: Synthetic peptide"
  MOD_RES (17)..(17): Lys(C20)
  source: /note="C-term amide"
HGQGTFTSDYSKYLDAXAAKEFIAWLLNT

SEQ ID NO: 469 - protein, 29 aa, Artificial Sequence
  source: /note="Description of Artificial Sequence: Synthetic peptide"
  MOD_RES (16)..(16): Aib
  MOD_RES (17)..(17): Lys(C8)
  source: /note="C-term amide"
HGQGTFTSDYSKYLDXXAAKEFIAWLLNT

SEQ ID NO: 470 - protein, 29 aa, Artificial Sequence
  source: /note="Description of Artificial Sequence: Synthetic peptide"
  MOD_RES (16)..(16): Aib
  MOD_RES (17)..(17): Lys(C12)
  source: /note="C-term amide"
HGQGTFTSDYSKYLDXXAAKEFIAWLLNT

SEQ ID NO: 471 - protein, 29 aa, Artificial Sequence
  source: /note="Description of Artificial Sequence: Synthetic peptide"
  MOD_RES (16)..(16): Aib
  MOD_RES (17)..(17): Lys(C14)
  source: /note="C-term amide"
HGQGTFTSDYSKYLDXXAAKEFIAWLLNT

SEQ ID NO: 472 - protein, 29 aa, Artificial Sequence
  source: /note="Description of Artificial Sequence: Synthetic peptide"
  MOD_RES (16)..(16): Aib
  MOD_RES (17)..(17): Lys(C16)
  source: /note="C-term amide"
HGQGTFTSDYSKYLDXXAAKEFIAWLLNT

SEQ ID NO: 473 - protein, 29 aa, Artificial Sequence
  source: /note="Description of Artificial Sequence: Synthetic peptide"
  MOD_RES (16)..(16): Aib
  MOD_RES (17)..(17): Lys(C18)
  source: /note="C-term amide"
HGQGTFTSDYSKYLDXXAAKEFIAWLLNT

SEQ ID NO: 474 - protein, 29 aa, Artificial Sequence
  source: /note="Description of Artificial Sequence: Synthetic peptide"
  MOD_RES (16)..(16): Aib
  MOD_RES (17)..(17): Lys(C20)
  source: /note="C-term amide"
HGQGTFTSDYSKYLDXXAAKEFIAWLLNT

SEQ ID NO: 475 - protein, 29 aa, Artificial Sequence
  source: /note="Description of Artificial Sequence: Synthetic peptide"
  MOD_RES (16)..(16): Aib
  MOD_RES (17)..(17): Lys(C8)
  source: /note="C-term amide"
HGQGTFTSDYSKYLDXXAAREFIAWLLNT

SEQ ID NO: 476 - protein, 29 aa, Artificial Sequence
  source: /note="Description of Artificial Sequence: Synthetic peptide"
  MOD_RES (16)..(16): Aib
  MOD_RES (17)..(17): Lys(C12)
  source: /note="C-term amide"
HGQGTFTSDYSKYLDXXAAREFIAWLLNT

SEQ ID NO: 477 - protein, 29 aa, Artificial Sequence
  source: /note="Description of Artificial Sequence: Synthetic peptide"
  MOD_RES (16)..(16): Aib
  MOD_RES (17)..(17): Lys(C14)
  source: /note="C-term amide"
HGQGTFTSDYSKYLDXXAAREFIAWLLNT

SEQ ID NO: 478 - protein, 29 aa, Artificial Sequence
  source: /note="Description of Artificial Sequence: Synthetic peptide"
  MOD_RES (16)..(16): Aib
  MOD_RES (17)..(17): Lys(C16)
  source: /note="C-term amide"
HGQGTFTSDYSKYLDXXAAREFIAWLLNT

SEQ ID NO: 479 - protein, 29 aa, Artificial Sequence
  source: /note="Description of Artificial Sequence: Synthetic peptide"
  MOD_RES (16)..(16): Aib
  MOD_RES (17)..(17): Lys(C18)
  source: /note="C-term amide"
HGQGTFTSDYSKYLDXXAAREFIAWLLNT

SEQ ID NO: 480 - protein, 29 aa, Artificial Sequence
  source: /note="Description of Artificial Sequence: Synthetic peptide"
  MOD_RES (16)..(16): Aib
  MOD_RES (17)..(17): Lys(C20)
  source: /note="C-term amide"
HGQGTFTSDYSKYLDXXAAREFIAWLLNT

SEQ ID NO: 481 - protein, 29 aa, Artificial Sequence
  source: /note="Description of Artificial Sequence: Synthetic peptide"
  MOD_RES (2)..(2): Aib
  MOD_RES (17)..(17): Lys(C8)
  source: /note="C-term amide"
HXQGTFTSDYSKYLDAXAAKEFIAWLLNT

SEQ ID NO: 482 - protein, 29 aa, Artificial Sequence
  source: /note="Description of Artificial Sequence: Synthetic peptide"
  MOD_RES (2)..(2): Aib
  MOD_RES (17)..(17): Lys(C12)
  source: /note="C-term amide"
HXQGTFTSDYSKYLDAXAAKEFIAWLLNT

SEQ ID NO: 483 - protein, 29 aa, Artificial Sequence
  source: /note="Description of Artificial Sequence: Synthetic peptide"
  MOD_RES (2)..(2): Aib
  MOD_RES (17)..(17): Lys(C14)
  source: /note="C-term amide"
HXQGTFTSDYSKYLDAXAAKEFIAWLLNT

SEQ ID NO: 484 - protein, 29 aa, Artificial Sequence
  source: /note="Description of Artificial Sequence: Synthetic peptide"
  MOD_RES (2)..(2): Aib
  MOD_RES (17)..(17): Lys(C16)
  source: /note="C-term amide"
HXQGTFTSDYSKYLDAXAAKEFIAWLLNT

SEQ ID NO: 485 - protein, 29 aa, Artificial Sequence
  source: /note="Description of Artificial Sequence: Synthetic peptide"
  MOD_RES (2)..(2): Aib
  MOD_RES (17)..(17): Lys(C18)
  source: /note="C-term amide"
HXQGTFTSDYSKYLDAXAAKEFIAWLLNT

SEQ ID NO: 486 - protein, 29 aa, Artificial Sequence
  source: /note="Description of Artificial Sequence: Synthetic peptide"
  MOD_RES (2)..(2): Aib
  MOD_RES (17)..(17): Lys(C20)
  source: /note="C-term amide"
HXQGTFTSDYSKYLDAXAAKEFIAWLLNT

SEQ ID NO: 487 - protein, 29 aa, Artificial Sequence
  source: /note="Description of Artificial Sequence: Synthetic peptide"
  MOD_RES (2)..(2): Aib
  MOD_RES (17)..(17): Lys(C8)
  source: /note="C-term amide"
HXQGTFTSDYSKYLDAXAAREFIAWLLNT

SEQ ID NO: 488 - protein, 29 aa, Artificial Sequence
  source: /note="Description of Artificial Sequence: Synthetic peptide"
  MOD_RES (2)..(2): Aib
  MOD_RES (17)..(17): Lys(C12)
  source: /note="C-term amide"
HXQGTFTSDYSKYLDAXAAREFIAWLLNT

SEQ ID NO: 489 - protein, 29 aa, Artificial Sequence
  source: /note="Description of Artificial Sequence: Synthetic peptide"
  MOD_RES (2)..(2): Aib
  MOD_RES (17)..(17): Lys(C14)
  source: /note="C-term amide"
HXQGTFTSDYSKYLDAXAAREFIAWLLNT

SEQ ID NO: 490 - protein, 29 aa, Artificial Sequence
  source: /note="Description of Artificial Sequence: Synthetic peptide"
  MOD_RES (2)..(2): Aib
  MOD_RES (17)..(17): Lys(C16)
  source: /note="C-term amide"
HXQGTFTSDYSKYLDAXAAREFIAWLLNT

SEQ ID NO: 491 - protein, 29 aa, Artificial Sequence
  source: /note="Description of Artificial Sequence: Synthetic peptide"
  MOD_RES (2)..(2): Aib
  MOD_RES (17)..(17): Lys(C18)
  source: /note="C-term amide"
HXQGTFTSDYSKYLDAXAAREFIAWLLNT

SEQ ID NO: 492 - protein, 29 aa, Artificial Sequence
  source: /note="Description of Artificial Sequence: Synthetic peptide"
  MOD_RES (2)..(2): Aib
  MOD_RES (17)..(17): Lys(C20)
  source: /note="C-term amide"
HXQGTFTSDYSKYLDAXAAREFIAWLLNT

SEQ ID NO: 493 - protein, 29 aa, Artificial Sequence
  source: /note="Description of Artificial Sequence: Synthetic peptide"
  MOD_RES (24)..(24): Lys(C8)
  source: /note="C-term amide"
HGQGTFTSDYSKYLDAQAAREFIXWLLNT

SEQ ID NO: 494 - protein, 29 aa, Artificial Sequence
  source: /note="Description of Artificial Sequence: Synthetic peptide"
  MOD_RES (24)..(24): Lys(C12)
  source: /note="C-term amide"
HGQGTFTSDYSKYLDAQAAREFIXWLLNT

SEQ ID NO: 495 - protein, 29 aa, Artificial Sequence
  source: /note="Description of Artificial Sequence: Synthetic peptide"
  MOD_RES (24)..(24): Lys(C14)
  source: /note="C-term amide"
HGQGTFTSDYSKYLDAQAAREFIXWLLNT

SEQ ID NO: 496 - protein, 29 aa, Artificial Sequence
  source: /note="Description of Artificial Sequence: Synthetic peptide"
  MOD_RES (24)..(24): Lys(C16)
  source: /note="C-term amide"
HGQGTFTSDYSKYLDAQAAREFIXWLLNT

SEQ ID NO: 497 - protein, 29 aa, Artificial Sequence
  source: /note="Description of Artificial Sequence: Synthetic peptide"
  MOD_RES (24)..(24): Lys(C18)
  source: /note="C-term amide"
HGQGTFTSDYSKYLDAQAAREFIXWLLNT

SEQ ID NO: 498 - protein, 29 aa, Artificial Sequence
  source: /note="Description of Artificial Sequence: Synthetic peptide"
  MOD_RES (24)..(24): Lys(C20)
  source: /note="C-term amide"
HGQGTFTSDYSKYLDAQAAREFIXWLLNT

SEQ ID NO: 499 - protein, 29 aa, Artificial Sequence
  source: /note="Description of Artificial Sequence: Synthetic peptide"
  MOD_RES (20)..(20): Lys(C8)
  source: /note="C-term amide"
HGQGTFTSDYSKYLDARRAXDFVQWLLNT

SEQ ID NO: 500 - protein, 29 aa, Artificial Sequence
  source: /note="Description of Artificial Sequence: Synthetic peptide"
  MOD_RES (20)..(20): Lys(12)
  source: /note="C-term amide"
HGQGTFTSDYSKYLDARRAXDFVQWLLNT

SEQ ID NO: 501 - protein, 29 aa, Artificial Sequence
  source: /note="Description of Artificial Sequence: Synthetic peptide"
  MOD_RES (20)..(20): Lys(C14)
  source: /note="C-term amide"
HGQGTFTSDYSKYLDARRAXDFVQWLLNT

SEQ ID NO: 502 - protein, 29 aa, Artificial Sequence
  source: /note="Description of Artificial Sequence: Synthetic peptide"
  MOD_RES (20)..(20): Lys(C16)
  source: /note="C-term amide"
HGQGTFTSDYSKYLDARRAXDFVQWLLNT

SEQ ID NO: 503 - protein, 29 aa, Artificial Sequence
  source: /note="Description of Artificial Sequence: Synthetic peptide"
  MOD_RES (20)..(20): Lys(C18)
  source: /note="C-term amide"
HGQGTFTSDYSKYLDARRAXDFVQWLLNT

SEQ ID NO: 504 - protein, 29 aa, Artificial Sequence
  source: /note="Description of Artificial Sequence: Synthetic peptide"
  MOD_RES (20)..(20): Lys(C20)
  source: /note="C-term amide"
HGQGTFTSDYSKYLDARRAXDFVQWLLNT

SEQ ID NO: 505 - protein, 29 aa, Artificial Sequence
  source: /note="Description of Artificial Sequence: Synthetic peptide"
  MOD_RES (2)..(2): Aib
  MOD_RES (20)..(20): Lys(C18)
  source: /note="C-term amide"
HXQGTFTSDYSKYLDARRAXDFVQWLLNT

SEQ ID NO: 506 - protein, 29 aa, Artificial Sequence
  source: /note="Description of Artificial Sequence: Synthetic peptide"
  MOD_RES (2)..(2): Aib
  MOD_RES (20)..(20): Lys(C8)
  source: /note="C-term amide"
HXQGTFTSDYSKYLDARRAXDFVQWLLNT

SEQ ID NO: 507 - protein, 29 aa, Artificial Sequence
  source: /note="Description of Artificial Sequence: Synthetic peptide"
  MOD_RES (2)..(2): Aib
  MOD_RES (20)..(20): Lys(C14)
  source: /note="C-term amide"
HXQGTFTSDYSKYLDARRAXDFVQWLLNT

SEQ ID NO: 508 - protein, 29 aa, Artificial Sequence
  source: /note="Description of Artificial Sequence: Synthetic peptide"
  MOD_RES (2)..(2): Aib
  MOD_RES (20)..(20): Lys(C16)
  source: /note="C-term amide"
HXQGTFTSDYSKYLDARRAXDFVQWLLNT

SEQ ID NO: 509 - protein, 29 aa, Artificial Sequence
  source: /note="Description of Artificial Sequence: Synthetic peptide"
  MOD_RES (2)..(2): Aib
  MOD_RES (20)..(20): Lys(C20)
  source: /note="C-term amide"
HXQGTFTSDYSKYLDARRAXDFVQWLLNT

SEQ ID NO: 510 - protein, 29 aa, Artificial Sequence
  source: /note="Description of Artificial Sequence: Synthetic peptide"
  MOD_RES (24)..(24): Lys(C8)
  source: /note="C-term amide"
HGQGTFTSDYSKYLDARRAQDFVXWLLNT

SEQ ID NO: 511 - protein, 29 aa, Artificial Sequence
  source: /note="Description of Artificial Sequence: Synthetic peptide"
  MOD_RES (24)..(24): Lys(C12)
  source: /note="C-term amide"
HGQGTFTSDYSKYLDARRAQDFVXWLLNT

SEQ ID NO: 512 - protein, 29 aa, Artificial Sequence
  source: /note="Description of Artificial Sequence: Synthetic peptide"
  MOD_RES (24)..(24): Lys(C14)
  source: /note="C-term amide"
HGQGTFTSDYSKYLDARRAQDFVXWLLNT

SEQ ID NO: 513 - protein, 29 aa, Artificial Sequence
  source: /note="Description of Artificial Sequence: Synthetic peptide"
  MOD_RES (24)..(24): Lys(C16)
  source: /note="C-term amide"
HGQGTFTSDYSKYLDARRAQDFVXWLLNT

SEQ ID NO: 514 - protein, 29 aa, Artificial Sequence
  source: /note="Description of Artificial Sequence: Synthetic peptide"
  MOD_RES (24)..(24): Lys(C18)
  source: /note="C-term amide"
HGQGTFTSDYSKYLDARRAQDFVXWLLNT

SEQ ID NO: 515 - protein, 29 aa, Artificial Sequence
  source: /note="Description of Artificial Sequence: Synthetic peptide"
  MOD_RES (24)..(24): Lys(C20)
  source: /note="C-term amide"
HGQGTFTSDYSKYLDARRAQDFVXWLLNT

SEQ ID NO: 516 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C18)
  source: /note="C-term amide"
HXQGTFTSDYSKYLDXXAAKEFIAWLLNT

SEQ ID NO: 517 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C8)
  source: /note="C-term amide"
HXQGTFTSDYSKYLDXXAAKEFIAWLLNT

SEQ ID NO: 518 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C12)
  source: /note="C-term amide"
HXQGTFTSDYSKYLDXXAAKEFIAWLLNT

SEQ ID NO: 519 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C14)
  source: /note="C-term amide"
HXQGTFTSDYSKYLDXXAAKEFIAWLLNT

SEQ ID NO: 520 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C16)
  source: /note="C-term amide"
HXQGTFTSDYSKYLDXXAAKEFIAWLLNT

SEQ ID NO: 521 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C18)
  source: /note="C-term amide"
HXQGTFTSDYSKYLDXXAAKEFIAWLLNT

SEQ ID NO: 522 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C20)
  source: /note="C-term amide"
HXQGTFTSDYSKYLDXXAAKEFIAWLLNT

SEQ ID NO: 523 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C8)
  source: /note="C-term amide"
HXQGTFTSDYSKYLDXXAAREFIAWLLNT

SEQ ID NO: 524 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C12)
  source: /note="C-term amide"
HXQGTFTSDYSKYLDXXAAREFIAWLLNT

SEQ ID NO: 525 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C14)
  source: /note="C-term amide"
HXQGTFTSDYSKYLDXXAAREFIAWLLNT

SEQ ID NO: 526 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C16)
  source: /note="C-term amide"
HXQGTFTSDYSKYLDXXAAREFIAWLLNT

SEQ ID NO: 527 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C18)
  source: /note="C-term amide"
HXQGTFTSDYSKYLDXXAAREFIAWLLNT

SEQ ID NO: 528 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C20)
  source: /note="C-term amide"
HXQGTFTSDYSKYLDXXAAREFIAWLLNT

SEQ ID NO: 529 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (20)..(20): Lys(C18)
  source: /note="C-term amide"
HXQGTFTSDYSKYLDXRRAXDFVQWLLNT

SEQ ID NO: 530 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (20)..(20): Lys(C8)
  source: /note="C-term amide"
HXQGTFTSDYSKYLDXRRAXDFVQWLLNT

SEQ ID NO: 531 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (20)..(20): Lys(C14)
  source: /note="C-term amide"
HXQGTFTSDYSKYLDXRRAXDFVQWLLNT

SEQ ID NO: 532 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (20)..(20): Lys(C16)
  source: /note="C-term amide"
HXQGTFTSDYSKYLDXRRAXDFVQWLLNT

SEQ ID NO: 533 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (20)..(20): Lys(C20)
  source: /note="C-term amide"
HXQGTFTSDYSKYLDXRRAXDFVQWLLNT

SEQ ID NO: 534 - protein, 29 aa, Artificial Sequence
  source: /note="Description of Artificial Sequence: Synthetic peptide"
  MOD_RES (16)..(16): Aib
  MOD_RES (20)..(20): Lys(C8)
  source: /note="C-term amide"
HGQGTFTSDYSKYLDXRRAXDFVQWLLNT

SEQ ID NO: 535 - protein, 29 aa, Artificial Sequence
  source: /note="Description of Artificial Sequence: Synthetic peptide"
  MOD_RES (16)..(16): Aib
  MOD_RES (20)..(20): Lys(C12)
  source: /note="C-term amide"
HGQGTFTSDYSKYLDXRRAXDFVQWLLNT

SEQ ID NO: 536 - protein, 29 aa, Artificial Sequence
  source: /note="Description of Artificial Sequence: Synthetic peptide"
  MOD_RES (16)..(16): Aib
  MOD_RES (20)..(20): Lys(C14)
  source: /note="C-term amide"
HGQGTFTSDYSKYLDXRRAXDFVQWLLNT

SEQ ID NO: 537 - protein, 29 aa, Artificial Sequence
  source: /note="Description of Artificial Sequence: Synthetic peptide"
  MOD_RES (16)..(16): Aib
  MOD_RES (20)..(20): Lys(C16)
  source: /note="C-term amide"
HGQGTFTSDYSKYLDXRRAXDFVQWLLNT

SEQ ID NO: 538 - protein, 29 aa, Artificial Sequence
  source: /note="Description of Artificial Sequence: Synthetic peptide"
  MOD_RES (16)..(16): Aib
  MOD_RES (20)..(20): Lys(C18)
  source: /note="C-term amide"
HGQGTFTSDYSKYLDXRRAXDFVQWLLNT

SEQ ID NO: 539 - protein, 29 aa, Artificial Sequence
  source: /note="Description of Artificial Sequence: Synthetic peptide"
  MOD_RES (16)..(16): Aib
  MOD_RES (20)..(20): Lys(C20)
  source: /note="C-term amide"
HGQGTFTSDYSKYLDXRRAXDFVQWLLNT

SEQ ID NO: 540 - protein, 29 aa, Artificial Sequence
  source: /note="Description of Artificial Sequence: Synthetic peptide"
  MOD_RES (16)..(16): Aib
  MOD_RES (24)..(24): Lys(C8)
  source: /note="C-term amide"
HGQGTFTSDYSKYLDXQAAREFIXWLLNT

SEQ ID NO: 541 - protein, 29 aa, Artificial Sequence
  source: /note="Description of Artificial Sequence: Synthetic peptide"
  MOD_RES (16)..(16): Aib
  MOD_RES (24)..(24): Lys(C12)
  source: /note="C-term amide"
HGQGTFTSDYSKYLDXQAAREFIXWLLNT

SEQ ID NO: 542 - protein, 29 aa, Artificial Sequence
  source: /note="Description of Artificial Sequence: Synthetic peptide"
  MOD_RES (16)..(16): Aib
  MOD_RES (24)..(24): Lys(C14)
  source: /note="C-term amide"
HGQGTFTSDYSKYLDXQAAREFIXWLLNT

SEQ ID NO: 543 - protein, 29 aa, Artificial Sequence
  source: /note="Description of Artificial Sequence: Synthetic peptide"
  MOD_RES (16)..(16): Aib
  MOD_RES (24)..(24): Lys(C16)
  source: /note="C-term amide"
HGQGTFTSDYSKYLDXQAAREFIXWLLNT

SEQ ID NO: 544 - protein, 29 aa, Artificial Sequence
  source: /note="Description of Artificial Sequence: Synthetic peptide"
  MOD_RES (16)..(16): Aib
  MOD_RES (24)..(24): Lys(C18)
  source: /note="C-term amide"
HGQGTFTSDYSKYLDXQAAREFIXWLLNT

SEQ ID NO: 545 - protein, 29 aa, Artificial Sequence
  source: /note="Description of Artificial Sequence: Synthetic peptide"
  MOD_RES (16)..(16): Aib
  MOD_RES (24)..(24): Lys(C20)
  source: /note="C-term amide"
HGQGTFTSDYSKYLDXQAAREFIXWLLNT

SEQ ID NO: 546 - protein, 29 aa, Artificial Sequence
  source: /note="Description of Artificial Sequence: Synthetic peptide"
  MOD_RES (16)..(16): Aib
  MOD_RES (24)..(24): Lys(C8)
  source: /note="C-term amide"
HGQGTFTSDYSKYLDXRRAQDFVXWLLNT

SEQ ID NO: 547 - protein, 29 aa, Artificial Sequence
  source: /note="Description of Artificial Sequence: Synthetic peptide"
  MOD_RES (16)..(16): Aib
  MOD_RES (24)..(24): Lys(C12)
  source: /note="C-term amide"
HGQGTFTSDYSKYLDXRRAQDFVXWLLNT

SEQ ID NO: 548 - protein, 29 aa, Artificial Sequence
  source: /note="Description of Artificial Sequence: Synthetic peptide"
  MOD_RES (16)..(16): Aib
  MOD_RES (24)..(24): Lys(C14)
  source: /note="C-term amide"
HGQGTFTSDYSKYLDXRRAQDFVXWLLNT

SEQ ID NO: 549 - protein, 29 aa, Artificial Sequence
  source: /note="Description of Artificial Sequence: Synthetic peptide"
  MOD_RES (16)..(16): Aib
  MOD_RES (24)..(24): Lys(C16)
  source: /note="C-term amide"
HGQGTFTSDYSKYLDXRRAQDFVXWLLNT

SEQ ID NO: 550 - protein, 29 aa, Artificial Sequence
  source: /note="Description of Artificial Sequence: Synthetic peptide"
  MOD_RES (16)..(16): Aib
  MOD_RES (24)..(24): Lys(C18)
  source: /note="C-term amide"
HGQGTFTSDYSKYLDXRRAQDFVXWLLNT

SEQ ID NO: 551 - protein, 29 aa, Artificial Sequence
  source: /note="Description of Artificial Sequence: Synthetic peptide"
  MOD_RES (16)..(16): Aib
  MOD_RES (24)..(24): Lys(C20)
  source: /note="C-term amide"
HGQGTFTSDYSKYLDXRRAQDFVXWLLNT

SEQ ID NO: 552 - protein, 29 aa, Artificial Sequence
  source: /note="Description of Artificial Sequence: Synthetic peptide"
  MOD_RES (24)..(24): Lys(C8)
  source: /note="C-term amide"
HGQGTFTSDYSKYLDEQAAREFIXWLLQT

SEQ ID NO: 553 - protein, 29 aa, Artificial Sequence
  source: /note="Description of Artificial Sequence: Synthetic peptide"
  MOD_RES (24)..(24): Lys(C12)
  source: /note="C-term amide"
HGQGTFTSDYSKYLDEQAAREFIXWLLQT

SEQ ID NO: 554 - protein, 29 aa, Artificial Sequence
  source: /note="Description of Artificial Sequence: Synthetic peptide"
  MOD_RES (24)..(24): Lys(C14)
  source: /note="C-term amide"
HGQGTFTSDYSKYLDEQAAREFIXWLLQT

SEQ ID NO: 555 - protein, 29 aa, Artificial Sequence
  source: /note="Description of Artificial Sequence: Synthetic peptide"
  MOD_RES (24)..(24): Lys(C16)
  source: /note="C-term amide"
HGQGTFTSDYSKYLDEQAAREFIXWLLQT

SEQ ID NO: 556 - protein, 29 aa, Artificial Sequence
  source: /note="Description of Artificial Sequence: Synthetic peptide"
  MOD_RES (24)..(24): Lys(C18)
  source: /note="C-term amide"
HGQGTFTSDYSKYLDEQAAREFIXWLLQT

SEQ ID NO: 557 - protein, 29 aa, Artificial Sequence
  source: /note="Description of Artificial Sequence: Synthetic peptide"
  MOD_RES (24)..(24): Lys(C20)
  source: /note="C-term amide"
HGQGTFTSDYSKYLDEQAAREFIXWLLQT

SEQ ID NO: 558 - protein, 29 aa, Artificial Sequence
  source: /note="Description of Artificial Sequence: Synthetic peptide"
  MOD_RES (17)..(17): Lys(C8)
  source: /note="C-term amide"
HGQGTFTSDYSKYLDEXAAREFIAWLLQT

SEQ ID NO: 559 - protein, 29 aa, Artificial Sequence
  source: /note="Description of Artificial Sequence: Synthetic peptide"
  MOD_RES (17)..(17): Lys(C12)
  source: /note="C-term amide"
HGQGTFTSDYSKYLDEXAAREFIAWLLQT

SEQ ID NO: 560 - protein, 29 aa, Artificial Sequence
  source: /note="Description of Artificial Sequence: Synthetic peptide"
  MOD_RES (17)..(17): Lys(C14)
  source: /note="C-term amide"
HGQGTFTSDYSKYLDEXAAREFIAWLLQT

SEQ ID NO: 561 - protein, 29 aa, Artificial Sequence
  source: /note="Description of Artificial Sequence: Synthetic peptide"
  MOD_RES (17)..(17): Lys(C16)
  source: /note="C-term amide"
HGQGTFTSDYSKYLDEXAAREFIAWLLQT

SEQ ID NO: 562 - protein, 29 aa, Artificial Sequence
  source: /note="Description of Artificial Sequence: Synthetic peptide"
  MOD_RES (17)..(17): Lys(C18)
  source: /note="C-term amide"
HGQGTFTSDYSKYLDEXAAREFIAWLLQT

SEQ ID NO: 563 - protein, 29 aa, Artificial Sequence
  source: /note="Description of Artificial Sequence: Synthetic peptide"
  MOD_RES (17)..(17): Lys(C20)
  source: /note="C-term amide"
HGQGTFTSDYSKYLDEXAAREFIAWLLQT

SEQ ID NO: 564 - protein, 29 aa, Artificial Sequence
  source: /note="Description of Artificial Sequence: Synthetic peptide"
  MOD_RES (17)..(17): Lys(C8)
  source: /note="C-term amide"
HGQGTFTSDYSKYLDEXAAKEFIAWLLQT

SEQ ID NO: 565 - protein, 29 aa, Artificial Sequence
  source: /note="Description of Artificial Sequence: Synthetic peptide"
  MOD_RES (17)..(17): Lys(C12)
  source: /note="C-term amide"
HGQGTFTSDYSKYLDEXAAKEFIAWLLQT

SEQ ID NO: 566 - protein, 29 aa, Artificial Sequence
  source: /note="Description of Artificial Sequence: Synthetic peptide"
  MOD_RES (17)..(17): Lys(C14)
  source: /note="C-term amide"
HGQGTFTSDYSKYLDEXAAKEFIAWLLQT

SEQ ID NO: 567 - protein, 29 aa, Artificial Sequence
  source: /note="Description of Artificial Sequence: Synthetic peptide"
  MOD_RES (17)..(17): Lys(C16)
  source: /note="C-term amide"
HGQGTFTSDYSKYLDEXAAKEFIAWLLQT

SEQ ID NO: 568 - protein, 29 aa, Artificial Sequence
  source: /note="Description of Artificial Sequence: Synthetic peptide"
  MOD_RES (17)..(17): Lys(C18)
  source: /note="C-term amide"
HGQGTFTSDYSKYLDEXAAKEFIAWLLQT

SEQ ID NO: 569 - protein, 29 aa, Artificial Sequence
  source: /note="Description of Artificial Sequence: Synthetic peptide"
  MOD_RES (17)..(17): Lys(C20)
  source: /note="C-term amide"
HGQGTFTSDYSKYLDEXAAKEFIAWLLQT

SEQ ID NO: 570 - protein, 29 aa, Artificial Sequence
  source: /note="Description of Artificial Sequence: Synthetic peptide"
  MOD_RES (2)..(2): Aib
  MOD_RES (17)..(17): Lys(C8)
  source: /note="C-term amide"
HXQGTFTSDYSKYLDEXAAKEFIAWLLQT

SEQ ID NO: 571 - protein, 29 aa, Artificial Sequence
  source: /note="Description of Artificial Sequence: Synthetic peptide"
  MOD_RES (2)..(2): Aib
  MOD_RES (17)..(17): Lys(C12)
  source: /note="C-term amide"
HXQGTFTSDYSKYLDEXAAKEFIAWLLQT

SEQ ID NO: 572 - protein, 29 aa, Artificial Sequence
  source: /note="Description of Artificial Sequence: Synthetic peptide"
  MOD_RES (2)..(2): Aib
  MOD_RES (17)..(17): Lys(C14)
  source: /note="C-term amide"
HXQGTFTSDYSKYLDEXAAKEFIAWLLQT

SEQ ID NO: 573 - protein, 29 aa, Artificial Sequence
  source: /note="Description of Artificial Sequence: Synthetic peptide"
  MOD_RES (2)..(2): Aib
  MOD_RES (17)..(17): Lys(C16)
  source: /note="C-term amide"
HXQGTFTSDYSKYLDEXAAKEFIAWLLQT

SEQ ID NO: 574 - protein, 29 aa, Artificial Sequence
  source: /note="Description of Artificial Sequence: Synthetic peptide"
  MOD_RES (2)..(2): Aib
  MOD_RES (17)..(17): Lys(C18)
  source: /note="C-term amide"
HXQGTFTSDYSKYLDEXAAKEFIAWLLQT

SEQ ID NO: 575 - protein, 29 aa, Artificial Sequence
  source: /note="Description of Artificial Sequence: Synthetic peptide"
  MOD_RES (2)..(2): Aib
  MOD_RES (17)..(17): Lys(C20)
  source: /note="C-term amide"
HXQGTFTSDYSKYLDEXAAKEFIAWLLQT

SEQ ID NO: 576 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C8)
  source: /note="C-term amide"
HXQGTFTSDYSKYLDXXAAREFIAWLLQT

SEQ ID NO: 577 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C12)
  source: /note="C-term amide"
HXQGTFTSDYSKYLDXXAAREFIAWLLQT

SEQ ID NO: 578 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C14)
  source: /note="C-term amide"
HXQGTFTSDYSKYLDXXAAREFIAWLLQT

SEQ ID NO: 579 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C16)
  source: /note="C-term amide"
HXQGTFTSDYSKYLDXXAAREFIAWLLQT

SEQ ID NO: 580 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C18)
  source: /note="C-term amide"
HXQGTFTSDYSKYLDXXAAREFIAWLLQT

SEQ ID NO: 581 - protein, 29 aa, Artificial Sequence
  source: /note="Description of Artificial Sequence: Synthetic peptide"
  MOD_RES (2)..(2): Aib
  MOD_RES (16)..(16): Aib
  MOD_RES (17)..(17): Lys(C20)
  source: /note="C-term amide"
HXQGTFTSDYSKYLDXXAAREFIAWLLQT

SEQ ID NO: 582 - protein, 29 aa, Artificial Sequence
  source: /note="Description of Artificial Sequence: Synthetic peptide"
  MOD_RES (20)..(20): Lys(C8)
  source: /note="C-term amide"
HGQGTFTSDYSKYLDERRAXDFVQWLLQT

SEQ ID NO: 583 - protein, 29 aa, Artificial Sequence
  source: /note="Description of Artificial Sequence: Synthetic peptide"
  MOD_RES (20)..(20): Lys(C12)
  source: /note="C-term amide"
HGQGTFTSDYSKYLDERRAXDFVQWLLQT

SEQ ID NO: 584 - protein, 29 aa, Artificial Sequence
  source: /note="Description of Artificial Sequence: Synthetic peptide"
  MOD_RES (20)..(20): Lys(C14)
  source: /note="C-term amide"
HGQGTFTSDYSKYLDERRAXDFVQWLLQT

SEQ ID NO: 585 - protein, 29 aa, Artificial Sequence
  source: /note="Description of Artificial Sequence: Synthetic peptide"
  MOD_RES (20)..(20): Lys(C16)
  source: /note="C-term amide"
HGQGTFTSDYSKYLDERRAXDFVQWLLQT

SEQ ID NO: 586 - protein, 29 aa, Artificial Sequence
  source: /note="Description of Artificial Sequence: Synthetic peptide"
  MOD_RES (20)..(20): Lys(C18)
  source: /note="C-term amide"
HGQGTFTSDYSKYLDERRAXDFVQWLLQT

SEQ ID NO: 587 - protein, 29 aa, Artificial Sequence
  source: /note="Description of Artificial Sequence: Synthetic peptide"
  MOD_RES (20)..(20): Lys(C20)
  source: /note="C-term amide"
HGQGTFTSDYSKYLDERRAXDFVQWLLQT

SEQ ID NO: 588 - protein, 29 aa, Artificial Sequence
  source: /note="Description of Artificial Sequence: Synthetic peptide"
  MOD_RES (2)..(2): Aib
  MOD_RES (20)..(20): Lys(C8)
  source: /note="C-term amide"
HXQGTFTSDYSKYLDERRAXDFVQWLLQT

SEQ ID NO: 589 - protein, 29 aa, Artificial Sequence
  source: /note="Description of Artificial Sequence: Synthetic peptide"
  MOD_RES (2)..(2): Aib
  MOD_RES (20)..(20): Lys(C12)
  source: /note="C-term amide"
HXQGTFTSDYSKYLDERRAXDFVQWLLQT

SEQ ID NO: 590 - protein, 29 aa, Artificial Sequence
  source: /note="Description of Artificial Sequence: Synthetic peptide"
  MOD_RES (2)..(2): Aib
  MOD_RES (20)..(20): Lys(C14)
  source: /note="C-term amide"
HXQGTFTSDYSKYLDERRAXDFVQWLLQT

SEQ ID NO: 591 - protein, 29 aa, Artificial Sequence
  source: /note="Description of Artificial Sequence: Synthetic peptide"
  MOD_RES (2)..(2): Aib
  MOD_RES (20)..(20): Lys(C16)
  source: /note="C-term amide"
HXQGTFTSDYSKYLDERRAXDFVQWLLQT

SEQ ID NO: 592 - protein, 29 aa, Artificial Sequence
  source: /note="Description of Artificial Sequence: Synthetic peptide"
  MOD_RES (2)..(2): Aib
  MOD_RES (20)..(20): Lys(C18)
  source: /note="C-term amide"
HXQGTFTSDYSKYLDERRAXDFVQWLLQT

SEQ ID NO: 593 - protein, 29 aa, Artificial Sequence
  source: /note="Description of Artificial Sequence: Synthetic peptide"
  MOD_RES (2)..(2): Aib
  MOD_RES (20)..(20): Lys(C20)
  source: /note="C-term amide"
HXQGTFTSDYSKYLDERRAXDFVQWLLQT

SEQ ID NO: 594 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C8)
  source: /note="C-term amide"
HXQGTFTSDYSKYLDEQAAKEFIXWLMQT

SEQ ID NO: 595 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C12)
  source: /note="C-term amide"
HXQGTFTSDYSKYLDEQAAKEFIXWLMQT

SEQ ID NO: 596 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C14)
  source: /note="C-term amide"
HXQGTFTSDYSKYLDEQAAKEFIXWLMQT

SEQ ID NO: 597 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C16)
  source: /note="C-term amide"
HXQGTFTSDYSKYLDEQAAKEFIXWLMQT

SEQ ID NO: 598 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C18)
  source: /note="C-term amide"
HXQGTFTSDYSKYLDEQAAKEFIXWLMQT

SEQ ID NO: 599 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C20)
  source: /note="C-term amide"
HXQGTFTSDYSKYLDEQAAKEFIXWLMQT

SEQ ID NO: 600 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C8)
  source: /note="C-term amide"
HXQGTFTSDYSKYLDEQAAKEFIXWLLQT

SEQ ID NO: 601 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C12)
  source: /note="C-term amide"
HXQGTFTSDYSKYLDEQAAKEFIXWLLQT

SEQ ID NO: 602 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C14)
  source: /note="C-term amide"
HXQGTFTSDYSKYLDEQAAKEFIXWLLQT

SEQ ID NO: 603 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C16)
  source: /note="C-term amide"
HXQGTFTSDYSKYLDEQAAKEFIXWLLQT

SEQ ID NO: 604 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C18)
  source: /note="C-term amide"
HXQGTFTSDYSKYLDEQAAKEFIXWLLQT

SEQ ID NO: 605 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C20)
  source: /note="C-term amide"
HXQGTFTSDYSKYLDEQAAKEFIXWLLQT

SEQ ID NO: 606 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(M8)
  source: /note="C-term amide"
HXQGTFTSDYSKYLDEQAAKEFIXWLLQT

SEQ ID NO: 607 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(M12)
  source: /note="C-term amide"
HXQGTFTSDYSKYLDEQAAKEFIXWLLQT

SEQ ID NO: 608 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(M14)
  source: /note="C-term amide"
HXQGTFTSDYSKYLDEQAAKEFIXWLLQT

SEQ ID NO: 609 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(M16)
  source: /note="C-term amide"
HXQGTFTSDYSKYLDEQAAKEFIXWLLQT

SEQ ID NO: 610 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(M18)
  source: /note="C-term amide"
HXQGTFTSDYSKYLDEQAAKEFIXWLLQT

SEQ ID NO: 611 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(M20)
  source: /note="C-term amide"
HXQGTFTSDYSKYLDEQAAKEFIXWLLQT

SEQ ID NO: 612 - protein, 29 aa, Artificial Sequence
  source: /note="Description of Artificial Sequence: Synthetic peptide"
  MOD_RES (24)..(24): Lys(M8)
  source: /note="C-term amide"
HGQGTFTSDYSKYLDEQAAREFIXWLLQT

SEQ ID NO: 613 - protein, 29 aa, Artificial Sequence
  source: /note="Description of Artificial Sequence: Synthetic peptide"
  MOD_RES (24)..(24): Lys(M12)
  source: /note="C-term amide"
HGQGTFTSDYSKYLDEQAAREFIXWLLQT

SEQ ID NO: 614 - protein, 29 aa, Artificial Sequence
  source: /note="Description of Artificial Sequence: Synthetic peptide"
  MOD_RES (24)..(24): Lys(M14)
  source: /note="C-term amide"
HGQGTFTSDYSKYLDEQAAREFIXWLLQT

SEQ ID NO: 615 - protein, 29 aa, Artificial Sequence
  source: /note="Description of Artificial Sequence: Synthetic peptide"
  MOD_RES (24)..(24): Lys(M16)
  source: /note="C-term amide"
HGQGTFTSDYSKYLDEQAAREFIXWLLQT

SEQ ID NO: 616 - protein, 29 aa, Artificial Sequence
  source: /note="Description of Artificial Sequence: Synthetic peptide"
  MOD_RES (24)..(24): Lys(M18)
  source: /note="C-term amide"
HGQGTFTSDYSKYLDEQAAREFIXWLLQT

SEQ ID NO: 617 - protein, 29 aa, Artificial Sequence
  source: /note="Description of Artificial Sequence: Synthetic peptide"
  MOD_RES (24)..(24): Lys(M20)
  source: /note="C-term amide"
HGQGTFTSDYSKYLDEQAAREFIXWLLQT

SEQ ID NO: 618 - protein, 29 aa, Artificial Sequence
  source: /note="Description of Artificial Sequence: Synthetic peptide"
  MOD_RES (17)..(17): Lys(M8)
  source: /note="C-term amide"
HGQGTFTSDYSKYLDEXAAKEFIAWLLNT

SEQ ID NO: 619 - protein, 29 aa, Artificial Sequence
  source: /note="Description of Artificial Sequence: Synthetic peptide"
  MOD_RES (17)..(17): Lys(M12)
  source: /note="C-term amide"
HGQGTFTSDYSKYLDEXAAKEFIAWLLNT

SEQ ID NO: 620 - protein, 29 aa, Artificial Sequence
  source: /note="Description of Artificial Sequence: Synthetic peptide"
  MOD_RES (17)..(17): Lys(M14)
  source: /note="C-term amide"
HGQGTFTSDYSKYLDEXAAKEFIAWLLNT

SEQ ID NO: 621 - protein, 29 aa, Artificial Sequence
  source: /note="Description of Artificial Sequence: Synthetic peptide"
  MOD_RES (17)..(17): Lys(M16)
  source: /note="C-term amide"
HGQGTFTSDYSKYLDEXAAKEFIAWLLNT

SEQ ID NO: 622 - protein, 29 aa, Artificial Sequence
  source: /note="Description of Artificial Sequence: Synthetic peptide"
  MOD_RES (17)..(17): Lys(M18)
  source: /note="C-term amide"
HGQGTFTSDYSKYLDEXAAKEFIAWLLNT

SEQ ID NO: 623 - protein, 29 aa, Artificial Sequence
  source: /note="Description of Artificial Sequence: Synthetic peptide"
  MOD_RES (17)..(17): Lys(M20)
  source: /note="C-term amide"
HGQGTFTSDYSKYLDEXAAKEFIAWLLNT

SEQ ID NO: 624 - protein, 29 aa, Artificial Sequence
  source: /note="Description of Artificial Sequence: Synthetic peptide"
  MOD_RES (17)..(17): Lys(M8)
  source: /note="C-term amide"
HGQGTFTSDYSKYLDEXAAREFIAWLLQT

SEQ ID NO: 625 - protein, 29 aa, Artificial Sequence
  source: /note="Description of Artificial Sequence: Synthetic peptide"
  MOD_RES (17)..(17): Lys(M12)
  source: /note="C-term amide"
HGQGTFTSDYSKYLDEXAAREFIAWLLQT

SEQ ID NO: 626 - protein, 29 aa, Artificial Sequence
  source: /note="Description of Artificial Sequence: Synthetic peptide"
  MOD_RES (17)..(17): Lys(M14)
  source: /note="C-term amide"
HGQGTFTSDYSKYLDEXAAREFIAWLLQT

SEQ ID NO: 627 - protein, 29 aa, Artificial Sequence
  source: /note="Description of Artificial Sequence: Synthetic peptide"
  MOD_RES (17)..(17): Lys(M16)
  source: /note="C-term amide"
HGQGTFTSDYSKYLDEXAAREFIAWLLQT

SEQ ID NO: 628 - protein, 29 aa, Artificial Sequence
  source: /note="Description of Artificial Sequence: Synthetic peptide"
  MOD_RES (17)..(17): Lys(M18)
  source: /note="C-term amide"
HGQGTFTSDYSKYLDEXAAREFIAWLLQT

SEQ ID NO: 629 - protein, 29 aa, Artificial Sequence
  source: /note="Description of Artificial Sequence: Synthetic peptide"
  MOD_RES (17)..(17): Lys(M20)
  source: /note="C-term amide"
HGQGTFTSDYSKYLDEXAAREFIAWLLQT

SEQ ID NO: 630 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me8)
  source: /note="C-term amide"
HXQGTFTSDYSKYLDEQAAKEFIXWLLQT

SEQ ID NO: 631 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me12)
  source: /note="C-term amide"
HXQGTFTSDYSKYLDEQAAKEFIXWLLQT

SEQ ID NO: 632 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me14)
  source: /note="C-term amide"
HXQGTFTSDYSKYLDEQAAKEFIXWLLQT

SEQ ID NO: 633 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me16)
  source: /note="C-term amide"
HXQGTFTSDYSKYLDEQAAKEFIXWLLQT

SEQ ID NO: 634 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me18)
  source: /note="C-term amide"
HXQGTFTSDYSKYLDEQAAKEFIXWLLQT

SEQ ID NO: 635 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me20)
  source: /note="C-term amide"
HXQGTFTSDYSKYLDEQAAKEFIXWLLQT

SEQ ID NO: 636 - protein, 29 aa, Artificial Sequence
  source: /note="Description of Artificial Sequence: Synthetic peptide"
  MOD_RES (24)..(24): Lys(Me8)
  source: /note="C-term amide"
HGQGTFTSDYSKYLDEQAAREFIXWLLQT

SEQ ID NO: 637 - protein, 29 aa, Artificial Sequence
  source: /note="Description of Artificial Sequence: Synthetic peptide"
  MOD_RES (24)..(24): Lys(Me12)
  source: /note="C-term amide"
HGQGTFTSDYSKYLDEQAAREFIXWLLQT

SEQ ID NO: 638 - protein, 29 aa, Artificial Sequence
  source: /note="Description of Artificial Sequence: Synthetic peptide"
  MOD_RES (24)..(24): Lys(Me14)
  source: /note="C-term amide"
HGQGTFTSDYSKYLDEQAAREFIXWLLQT

SEQ ID NO: 639 - protein, 29 aa, Artificial Sequence
  source: /note="Description of Artificial Sequence: Synthetic peptide"
  MOD_RES (24)..(24): Lys(Me16)
  source: /note="C-term amide"
HGQGTFTSDYSKYLDEQAAREFIXWLLQT

SEQ ID NO: 640 - protein, 29 aa, Artificial Sequence
  source: /note="Description of Artificial Sequence: Synthetic peptide"
  MOD_RES (24)..(24): Lys(Me18)
  source: /note="C-term amide"
HGQGTFTSDYSKYLDEQAAREFIXWLLQT

SEQ ID NO: 641 - protein, 29 aa, Artificial Sequence
  source: /note="Description of Artificial Sequence: Synthetic peptide"
  MOD_RES (24)..(24): Lys(Me20)
  source: /note="C-term amide"
HGQGTFTSDYSKYLDEQAAREFIXWLLQT

SEQ ID NO: 642 - protein, 29 aa, Artificial Sequence
  source: /note="Description of Artificial Sequence: Synthetic peptide"
  MOD_RES (17)..(17): Lys(Me8)
  source: /note="C-term amide"
HGQGTFTSDYSKYLDEXAAKEFIAWLLNT

SEQ ID NO: 643 - protein, 29 aa, Artificial Sequence
  source: /note="Description of Artificial Sequence: Synthetic peptide"
  MOD_RES (17)..(17): Lys(Me12)
  source: /note="C-term amide"
HGQGTFTSDYSKYLDEXAAKEFIAWLLNT

SEQ ID NO: 644 - protein, 29 aa, Artificial Sequence
  source: /note="Description of Artificial Sequence: Synthetic peptide"
  MOD_RES (17)..(17): Lys(Me14)
  source: /note="C-term amide"
HGQGTFTSDYSKYLDEXAAKEFIAWLLNT

SEQ ID NO: 645 - protein, 29 aa, Artificial Sequence
  source: /note="Description of Artificial Sequence: Synthetic peptide"
  MOD_RES (17)..(17): Lys(Me16)
  source: /note="C-term amide"
HGQGTFTSDYSKYLDEXAAKEFIAWLLNT

SEQ ID NO: 646 - protein, 29 aa, Artificial Sequence
  source: /note="Description of Artificial Sequence: Synthetic peptide"
  MOD_RES (17)..(17): Lys(Me18)
  source: /note="C-term amide"
HGQGTFTSDYSKYLDEXAAKEFIAWLLNT

SEQ ID NO: 647 - protein, 29 aa, Artificial Sequence
  source: /note="Description of Artificial Sequence: Synthetic peptide"
  MOD_RES (17)..(17): Lys(Me20)
  source: /note="C-term amide"
HGQGTFTSDYSKYLDEXAAKEFIAWLLNT

SEQ ID NO: 648 - protein, 29 aa, Artificial Sequence
  source: /note="Description of Artificial Sequence: Synthetic peptide"
  MOD_RES (17)..(17): Lys(Me8)
  source: /note="C-term amide"
HGQGTFTSDYSKYLDEXAAREFIAWLLQT

SEQ ID NO: 649 - protein, 29 aa, Artificial Sequence
  source: /note="Description of Artificial Sequence: Synthetic peptide"
  MOD_RES (17)..(17): Lys(Me12)
  source: /note="C-term amide"
HGQGTFTSDYSKYLDEXAAREFIAWLLQT

SEQ ID NO: 650 - protein, 29 aa, Artificial Sequence
  source: /note="Description of Artificial Sequence: Synthetic peptide"
  MOD_RES (17)..(17): Lys(Me14)
  source: /note="C-term amide"
HGQGTFTSDYSKYLDEXAAREFIAWLLQT

SEQ ID NO: 651 - protein, 29 aa, Artificial Sequence
  source: /note="Description of Artificial Sequence: Synthetic peptide"
  MOD_RES (17)..(17): Lys(Me16)
  source: /note="C-term amide"
HGQGTFTSDYSKYLDEXAAREFIAWLLQT

SEQ ID NO: 652 - protein, 29 aa, Artificial Sequence
  source: /note="Description of Artificial Sequence: Synthetic peptide"
  MOD_RES (17)..(17): Lys(Me18)
  source: /note="C-term amide"
HGQGTFTSDYSKYLDEXAAREFIAWLLQT

SEQ ID NO: 653 - protein, 29 aa, Artificial Sequence
  source: /note="Description of Artificial Sequence: Synthetic peptide"
  MOD_RES (17)..(17): Lys(Me20)
  source: /note="C-term amide"
HGQGTFTSDYSKYLDEXAAREFIAWLLQT

SEQ ID NO: 654 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): Lys(C8)
  source: /note="C-term amide"
HXQGTXTSDXX

SEQ ID NO: 655 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): Lys(C12)
  source: /note="C-term amide"
HXQGTXTSDXX

SEQ ID NO: 656 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): Lys(C14)
  source: /note="C-term amide"
HXQGTXTSDXX

SEQ ID NO: 657 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): Lys(C16)
  source: /note="C-term amide"
HXQGTXTSDXX

SEQ ID NO: 658 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): Lys(C18)
  source: /note="C-term amide"
HXQGTXTSDXX

SEQ ID NO: 659 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): Lys(C20)
  source: /note="C-term amide"
HXQGTXTSDXX

SEQ ID NO: 660 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): Lys(C8)
  source: /note="C-term amide"
HXQGTXTSDXX

SEQ ID NO: 661 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): Lys(C12)
  source: /note="C-term amide"
HXQGTXTSDXX

SEQ ID NO: 662 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): Lys(C14)
  source: /note="C-term amide"
HXQGTXTSDXX

SEQ ID NO: 663 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): Lys(C16)
  source: /note="C-term amide"
HXQGTXTSDXX

SEQ ID NO: 664 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): Lys(C18)
  source: /note="C-term amide"
HXQGTXTSDXX

SEQ ID NO: 665 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): Lys(C20)
  source: /note="C-term amide"
HXQGTXTSDXX

SEQ ID NO: 666 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): Lys(C8)
  source: /note="C-term amide"
HXQGTXTSDXX

SEQ ID NO: 667 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): Lys(C12)
  source: /note="C-term amide"
HXQGTXTSDXX

SEQ ID NO: 668 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): Lys(C14)
  source: /note="C-term amide"
HXQGTXTSDXX

SEQ ID NO: 669 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): Lys(C16)
  source: /note="C-term amide"
HXQGTXTSDXX

SEQ ID NO: 670 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): Lys(C18)
  source: /note="C-term amide"
HXQGTXTSDXX

SEQ ID NO: 671 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): Lys(C20)
  source: /note="C-term amide"
HXQGTXTSDXX

SEQ ID NO: 672 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): Lys(C8)
  source: /note="C-term amide"
HXQGTXTSDXX

SEQ ID NO: 673 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): Lys(C12)
  source: /note="C-term amide"
HXQGTXTSDXX

SEQ ID NO: 674 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): Lys(C14)
  source: /note="C-term amide"
HXQGTXTSDXX

SEQ ID NO: 675 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): Lys(C16)
  source: /note="C-term amide"
HXQGTXTSDXX

SEQ ID NO: 676 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): Lys(C18)
  source: /note="C-term amide"
HXQGTXTSDXX

SEQ ID NO: 677 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): Lys(C20)
  source: /note="C-term amide"
HXQGTXTSDXX

SEQ ID NO: 678 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): MeLys(C8)
  source: /note="C-term amide"
HXQGTXTSDXX

SEQ ID NO: 679 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): MeLys(C12)
  source: /note="C-term amide"
HXQGTXTSDXX

SEQ ID NO: 680 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): MeLys(C14)
  source: /note="C-term amide"
HXQGTXTSDXX

SEQ ID NO: 681 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): MeLys(C16)
  source: /note="C-term amide"
HXQGTXTSDXX

SEQ ID NO: 682 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): MeLys(C18)
  source: /note="C-term amide"
HXQGTXTSDXX

SEQ ID NO: 683 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): MeLys(C20)
  source: /note="C-term amide"
HXQGTXTSDXX

SEQ ID NO: 684 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): MeLys(C8)
  source: /note="C-term amide"
HXQGTXTSDXX

SEQ ID NO: 685 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): MeLys(C12)
  source: /note="C-term amide"
HXQGTXTSDXX

SEQ ID NO: 686 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): MeLys(C14)
  source: /note="C-term amide"
HXQGTXTSDXX

SEQ ID NO: 687 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): MeLys(C16)
  source: /note="C-term amide"
HXQGTXTSDXX

SEQ ID NO: 688 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): MeLys(C18)
  source: /note="C-term amide"
HXQGTXTSDXX

SEQ ID NO: 689 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): MeLys(C20)
  source: /note="C-term amide"
HXQGTXTSDXX

SEQ ID NO: 690 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): MeLys(C8)
  source: /note="C-term amide"
HXQGTXTSDXX

SEQ ID NO: 691 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): MeLys(C12)
  source: /note="C-term amide"
HXQGTXTSDXX

SEQ ID NO: 692 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): MeLys(C14)
  source: /note="C-term amide"
HXQGTXTSDXX

SEQ ID NO: 693 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): MeLys(C16)
  source: /note="C-term amide"
HXQGTXTSDXX

SEQ ID NO: 694 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): MeLys(C18)
  source: /note="C-term amide"
HXQGTXTSDXX

SEQ ID NO: 695 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): MeLys(C20)
  source: /note="C-term amide"
HXQGTXTSDXX

SEQ ID NO: 696 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): MeLys(C8)
  source: /note="C-term amide"
HXQGTXTSDXX

SEQ ID NO: 697 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): MeLys(C12)
  source: /note="C-term amide"
HXQGTXTSDXX

SEQ ID NO: 698 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): MeLys(C14)
  source: /note="C-term amide"
HXQGTXTSDXX

SEQ ID NO: 699 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): MeLys(C16)
  source: /note="C-term amide"
HXQGTXTSDXX

SEQ ID NO: 700 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): MeLys(C18)
  source: /note="C-term amide"
HXQGTXTSDXX

SEQ ID NO: 701 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): MeLys(C20)
  source: /note="C-term amide"
HXQGTXTSDXX

SEQ ID NO: 702 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): Lys Me8
  source: /note="C-term amide"
HXQGTXTSDXX

SEQ ID NO: 703 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): Lys Me12
  source: /note="C-term amide"
HXQGTXTSDXX

SEQ ID NO: 704 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): Lys Me14
  source: /note="C-term amide"
HXQGTXTSDXX

SEQ ID NO: 705 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): Lys Me16
  source: /note="C-term amide"
HXQGTXTSDXX

SEQ ID NO: 706 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): Lys Me18
  source: /note="C-term amide"
HXQGTXTSDXX

SEQ ID NO: 707 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): EtBip
  MOD_RES (11)..(11): Lys Me20
  source: /note="C-term amide"
HXQGTXTSDXX

SEQ ID NO: 708 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): Lys Me8
  source: /note="C-term amide"
HXQGTXTSDXX

SEQ ID NO: 709 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): Lys Me12
  source: /note="C-term amide"
HXQGTXTSDXX

SEQ ID NO: 710 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): Lys Me14
  source: /note="C-term amide"
HXQGTXTSDXX

SEQ ID NO: 711 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): Lys Me16
  source: /note="C-term amide"
HXQGTXTSDXX

SEQ ID NO: 712 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): Lys Me18
  source: /note="C-term amide"
HXQGTXTSDXX

SEQ ID NO: 713 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): EtBip
  MOD_RES (11)..(11): Lys Me20
  source: /note="C-term amide"
HXQGTXTSDXX

SEQ ID NO: 714 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): Lys Me8
  source: /note="C-term amide"
HXQGTXTSDXX

SEQ ID NO: 715 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): Lys Me12
  source: /note="C-term amide"
HXQGTXTSDXX

SEQ ID NO: 716 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): Lys Me14
  source: /note="C-term amide"
HXQGTXTSDXX

SEQ ID NO: 717 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): Lys Me16
  source: /note="C-term amide"
HXQGTXTSDXX

SEQ ID NO: 718 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): EtBip
  MOD_RES (11)..(11): Lys Me18
  source: /note="C-term amide"
HXQGTXTSDXX

SEQ ID NO: 719 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): Lys Me20
  source: /note="C-term amide"
HXQGTXTSDXX

SEQ ID NO: 720 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): Lys Me8
  source: /note="C-term amide"
HXQGTXTSDXX

SEQ ID NO: 721 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): Lys Me12
  source: /note="C-term amide"
HXQGTXTSDXX

SEQ ID NO: 722 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): Lys Me14
  source: /note="C-term amide"
HXQGTXTSDXX

SEQ ID NO: 723 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): Lys Me16
  source: /note="C-term amide"
HXQGTXTSDXX

SEQ ID NO: 724 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): Lys Me18
  source: /note="C-term amide"
HXQGTXTSDXX

SEQ ID NO: 725 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): EtBip
  MOD_RES (11)..(11): Lys Me20
  source: /note="C-term amide"
HXQGTXTSDXX

SEQ ID NO: 726 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): MeLys(C8)
  source: /note="C-term amide"
HXQGTXTSDXX

SEQ ID NO: 727 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): MeLys(C12)
  source: /note="C-term amide"
HXQGTXTSDXX

SEQ ID NO: 728 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): MeLys(C14)
  source: /note="C-term amide"
HXQGTXTSDXX

SEQ ID NO: 729 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): MeLys(C16)
  source: /note="C-term amide"
HXQGTXTSDXX

SEQ ID NO: 730 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): MeLys(C18)
  source: /note="C-term amide"
HXQGTXTSDXX

SEQ ID NO: 731 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): MeLys(C20)
  source: /note="C-term amide"
HXQGTXTSDXX

SEQ ID NO: 732 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): MeLys(C8)
  source: /note="C-term amide"
HXQGTXTSDXX

SEQ ID NO: 733 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): MeLys(C12)
  source: /note="C-term amide"
HXQGTXTSDXX

SEQ ID NO: 734 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): MeLys(C14)
  source: /note="C-term amide"
HXQGTXTSDXX

SEQ ID NO: 735 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): MeLys(C16)
  source: /note="C-term amide"
HXQGTXTSDXX

SEQ ID NO: 736 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): MeLys(C18)
  source: /note="C-term amide"
HXQGTXTSDXX

SEQ ID NO: 737 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): MeLys(C20)
  source: /note="C-term amide"
HXQGTXTSDXX

SEQ ID NO: 738 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): MeLys(C8)
  source: /note="C-term amide"
HXQGTXTSDXX

SEQ ID NO: 739 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): MeLys(C12)
  source: /note="C-term amide"
HXQGTXTSDXX

SEQ ID NO: 740 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): MeLys(C14)
  source: /note="C-term amide"
HXQGTXTSDXX

SEQ ID NO: 741 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): MeLys(C16)
  source: /note="C-term amide"
HXQGTXTSDXX

SEQ ID NO: 742 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): MeLys(C18)
  source: /note="C-term amide"
HXQGTXTSDXX

SEQ ID NO: 743 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): MeLys(C20)
  source: /note="C-term amide"
HXQGTXTSDXX

SEQ ID NO: 744 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): MeLys(C8)
  source: /note="C-term amide"
HXQGTXTSDXX

SEQ ID NO: 745 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): MeLys(C12)
  source: /note="C-term amide"
HXQGTXTSDXX

SEQ ID NO: 746 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): MeLys(C14)
  source: /note="C-term amide"
HXQGTXTSDXX

SEQ ID NO: 747 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): MeLys(C16)
  source: /note="C-term amide"
HXQGTXTSDXX

SEQ ID NO: 748 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): MeLys(C18)
  source: /note="C-term amide"
HXQGTXTSDXX

SEQ ID NO: 749 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): MeLys(C20)
  source: /note="C-term amide"
HXQGTXTSDXX

SEQ ID NO: 750 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): Lys Me8
  source: /note="C-term amide"
HXQGTXTSDXX

SEQ ID NO: 751 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): Lys Me12
  source: /note="C-term amide"
HXQGTXTSDXX

SEQ ID NO: 752 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): Lys Me14
  source: /note="C-term amide"
HXQGTXTSDXX

SEQ ID NO: 753 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): Lys Me16
  source: /note="C-term amide"
HXQGTXTSDXX

SEQ ID NO: 754 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): Lys Me18
  source: /note="C-term amide"
HXQGTXTSDXX

SEQ ID NO: 755 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeF
  MOD_RES (10)..(10): Bip
  MOD_RES (11)..(11): Lys Me20
  source: /note="C-term amide"
HXQGTXTSDXX

SEQ ID NO: 756 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): Lys Me8
  source: /note="C-term amide"
HXQGTXTSDXX

SEQ ID NO: 757 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): Lys Me12
  source: /note="C-term amide"
HXQGTXTSDXX

SEQ ID NO: 758 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): Lys Me14
  source: /note="C-term amide"
HXQGTXTSDXX

SEQ ID NO: 759 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): Lys Me16
  source: /note="C-term amide"
HXQGTXTSDXX

SEQ ID NO: 760 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): Lys Me18
  source: /note="C-term amide"
HXQGTXTSDXX

SEQ ID NO: 761 - protein, 11 aa, Artificial Sequence
  source: /note="Description of Artificial Sequence: Synthetic peptide"
  MOD_RES (2)..(2): Alpha-MePro
  MOD_RES (6)..(6): Alpha-MeFF
  MOD_RES (10)..(10): Bip
  MOD_RES (11)..(11): Lys Me20
  source: /note="C-term amide"
HXQGTXTSDXX

SEQ ID NO: 762 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): Lys Me8
  source: /note="C-term amide"
HXQGTXTSDXX

SEQ ID NO: 763 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): Lys Me12
  source: /note="C-term amide"
HXQGTXTSDXX

SEQ ID NO: 764 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): Lys Me14
  source: /note="C-term amide"
HXQGTXTSDXX

SEQ ID NO: 765 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): Lys Me16
  source: /note="C-term amide"
HXQGTXTSDXX

SEQ ID NO: 766 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): Lys Me18
  source: /note="C-term amide"
HXQGTXTSDXX

SEQ ID NO: 767 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): Lys Me20
  source: /note="C-term amide"
HXQGTXTSDXX

SEQ ID NO: 768 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): Lys Me8
  source: /note="C-term amide"
HXQGTXTSDXX

SEQ ID NO: 769 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): Lys Me12
  source: /note="C-term amide"
HXQGTXTSDXX

SEQ ID NO: 770 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): Lys Me14
  source: /note="C-term amide"
HXQGTXTSDXX

SEQ ID NO: 771 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): Lys Me16
  source: /note="C-term amide"
HXQGTXTSDXX

SEQ ID NO: 772 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): Lys Me18
  source: /note="C-term amide"
HXQGTXTSDXX

SEQ ID NO: 773 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): Lys Me20
  source: /note="C-term amide"
HXQGTXTSDXX

SEQ ID NO: 774 - protein, 29 aa, Artificial Sequence
  source: /note="Description of Artificial Sequence: Synthetic peptide"
  VARIANT (2)..(2): /replace="Aib"
  VARIANT (16)..(16): /replace="Ser" or "Ala" or "Lys" or "Aib"
  VARIANT (17)..(17): /replace="Glu" or "Lys" or "U(X); wherein 'U' is a natural or unnatural amino acid comprising a functional group covalently attached to the surfactant X"
  VARIANT (20)..(20): /replace="Glu" or "Arg"
  VARIANT (23)..(23): /replace="Val"
  VARIANT (24)..(24): /replace="Gln" or "U(X); wherein 'U' is a natural or unnatural amino acid comprising a functional group covalently attached to the surfactant X"
  VARIANT (27)..(27): /replace="Val" or "Leu"
  VARIANT (28)..(28): /replace="Gln" or "U(X); wherein 'U' is a natural or unnatural amino acid comprising a functional group covalently attached to the surfactant X"
  source: /note="C-term amide"
  SITE (1)..(29): /note="Variant residues given in the sequence have no preference with respect to those in the annotations for variant positions"
HGQGTFTSDYSKYLDEQAAKEFIAWLMNT

SEQ ID NO: 775 - protein, 29 aa, Artificial Sequence
  source: /note="Description of Artificial Sequence: Synthetic peptide"
  VARIANT (2)..(2): /replace="Aib"
  VARIANT (16)..(16): /replace="Ala" or "Aib"
  MOD_RES (17)..(17): U(X); wherein 'U' is a natural or unnatural amino acid comprising a functional group covalently attached to the surfactant X
  VARIANT (27)..(27): /replace="Val"
  source: /note="C-term amide"
  SITE (1)..(29): /note="Variant residues given in the sequence have no preference with respect to those in the annotations for variant positions"
HGQGTFTSDYSKYLDEXAAKEFIQWLLNT

SEQ ID NO: 776 - protein, 29 aa, Artificial Sequence
  source: /note="Description of Artificial Sequence: Synthetic peptide"
  VARIANT (2)..(2): /replace="Aib"
  VARIANT (16)..(16): /replace="Ser" or "Ala" or "Aib"
  VARIANT (17)..(17): /replace="hArg" or "Gln"
  VARIANT (20)..(20): /replace="U(X); wherein 'U' is a natural or unnatural amino acid comprising a functional group covalently attached to the surfactant X"
  VARIANT (23)..(23): /replace="Val"
  VARIANT (24)..(24): /replace="Ala" or "U(X); wherein 'U' is a natural or unnatural amino acid comprising a functional group covalently attached to the surfactant X"
  VARIANT (27)..(27): /replace="Val"
  VARIANT (28)..(28): /replace="Gln" or "U(X); wherein 'U' is a natural or unnatural amino acid comprising a functional group covalently attached to the surfactant X"
  source: /note="C-term amide"
  SITE (1)..(29): /note="Variant residues given in the sequence have no preference with respect to those in the annotations for variant positions"
HGQGTFTSDYSKYLDERRAKDFIAWLLNT

SEQ ID NO: 777 - protein, 29 aa, Artificial Sequence
  source: /note="Description of Artificial Sequence: Synthetic peptide"
  VARIANT (2)..(2): /replace="Aib"
  VARIANT (16)..(16): /replace="Ser" or "Ala" or "Aib"
  VARIANT (17)..(17): /replace="hArg" or "Gln"
  VARIANT (20)..(20): /replace="U(X); wherein 'U' is a natural or unnatural amino acid comprising a functional group covalently attached to the surfactant X"
  VARIANT (23)..(23): /replace="Val"
  VARIANT (24)..(24): /replace="Ala" or "U(X); wherein 'U' is a natural or unnatural amino acid comprising a functional group covalently attached to the surfactant X"
  VARIANT (27)..(27): /replace="Val"
  VARIANT (28)..(28): /replace="Gln" or "U(X); wherein 'U' is a natural or unnatural amino acid comprising a functional group covalently attached to the surfactant X"
  source: /note="C-term amide"
  SITE (1)..(29): /note="Variant residues given in the sequence have no preference with respect to those in the annotations for variant positions"
HGQGTFTSDYSKYLDERRAKDFIQWLLNT

SEQ ID NO: 778 - protein, 29 aa, Artificial Sequence
  source: /note="Description of Artificial Sequence: Synthetic peptide"
  VARIANT (2)..(2): /replace="Gly"
  VARIANT (16)..(16): /replace="Glu"
  SITE (16)..(20): /note="Cyclized through side chain to form a lactam linkage"
  VARIANT (17)..(17): /replace="hArg" or "Gln"
  VARIANT (20)..(20): /replace="Glu"
  MOD_RES (24)..(24): Lys(N-omega-X)
  VARIANT (27)..(27): /replace="Val" or "Leu" or "Nle"
  VARIANT (28)..(28): /replace="Gln"
  source: /note="C-term amide"
  SITE (1)..(29): /note="Variant residues given in the sequence have no preference with respect to those in the annotations for variant positions"
HGQGTFTSDYSKYLDKRAAKEFIXWLMNT

SEQ ID NO: 779 - protein, 29 aa, Artificial Sequence
  source: /note="Description of Artificial Sequence: Synthetic peptide"
  VARIANT (2)..(2): /replace="Gly"
  VARIANT (16)..(16): /replace="Ala" or "Aib"
  MOD_RES (17)..(17): Lys(N-omega-X)
  SITE (1)..(29): /note="Variant residues given in the sequence have no preference with respect to those in the annotations for variant positions"
  source: /note="C-term amide"
  source: /note="See specification as filed for detailed description of substitutions and preferred embodiments"
HGQGTFTSDYSKYLDEXAAKEFIAWLLNT

SEQ ID NO: 780 - protein, 29 aa, Artificial Sequence
  source: /note="Description of Artificial Sequence: Synthetic peptide"
  VARIANT (2)..(2): /replace="Aib"
  VARIANT (16)..(16): /replace="Ala" or "Aib"
  VARIANT (17)..(17): /replace="hArg"
  MOD_RES (20)..(20): Lys(N-omega-X)
  VARIANT (23)..(23): /replace="Val"
  VARIANT (24)..(24): /replace="Ala"
  VARIANT (27)..(27): /replace="Val"
  VARIANT (28)..(28): /replace="Gln"
  source: /note="C-term amide"
  SITE (1)..(29): /note="Variant residues given in the sequence have no preference with respect to those in the annotations for variant positions"
  source: /note="See specification as filed for detailed description of substitutions and preferred embodiments"
HGQGTFTSDYSKYLDERRAXDFIQWLLNT

SEQ ID NO: 781 - protein, 11 aa, Artificial Sequence
  source: /note="Description of Artificial Sequence: Synthetic peptide"
  VARIANT (2)..(2): /replace="Aib" or "MePro"
  VARIANT (6)..(6): /replace="2FPhe" or "MePhe" or "2FMePhe"
  VARIANT (10)..(10): /replace="Nal2" or "Bip" or "Bip2Et" or "Bip2EtMeO"
  MOD_RES (11)..(11): Lys(N-omega-X)
  source: /note="C-term -OH or -NH-R3"
  SITE (1)..(11): /note="Variant residues given in the sequence have no preference with respect to those in the annotations for variant positions"
  source: /note="See specification as filed for detailed description of substitutions and preferred embodiments"
HGQGTFTSDYX

SEQ ID NO: 782 - protein, 17 aa, Artificial Sequence
  source: /note="Description of Artificial Sequence: Synthetic peptide"
  source /note="N-term Fmoc"
  MOD_RES (2)..(2): Aib
  MOD_RES (10)..(10): Bip
  MOD_RES (17)..(17): Lys(Alloc)
HXQGTFTSDXSKYLESX

SEQ ID NO: 783 - protein, 29 aa, Artificial Sequence
  source: /note="Description of Artificial Sequence: Synthetic peptide"
  source /note="N-term Boc"
  MOD_RES (1)..(1): His(Trt)
  MOD_RES (2)..(2): Aib
  MOD_RES (3)..(3): Gln(Trt)
  MOD_RES (5)..(5): Thr(tBu)
  MOD_RES (7)..(7): Thr(tBu)
  MOD_RES (8)..(8): Ser(tBu)
  MOD_RES (9)..(9): Asp(OtBu)
  MOD_RES (10)..(10): Tyr(tBu)
  MOD_RES (11)..(11): Ser(tBu)
  MOD_RES (12)..(12): Lys(Boc)
  MOD_RES (13)..(13): Tyr(tBu)
  MOD_RES (15)..(15): Asp(OtBu)
  MOD_RES (16)..(16): Glu(O-Allyl)
  MOD_RES (17)..(17): Gln(Trt)
  MOD_RES (20)..(20): Lys(Alloc)
  MOD_RES (21)..(21): Glu(O-tBu)
  MOD_RES (24)..(24): Lys(Dde)
  MOD_RES (25)..(25): Trp(Boc)
  MOD_RES (28)..(28): Gln(Trt)
  MOD_RES (29)..(29): Thr(tBu)
  source: /note="C-term HMPA"
XXXGXFXXXXXXXLXXXAAXXFIXXLLXX

SEQ ID NO: 784-794 - skipped (11 entries)

SEQ ID NO: 795 - protein, 29 aa, Artificial Sequence
  source: /note="Description of Artificial Sequence: Synthetic peptide"
  VARIANT (2)..(2): /replace="Aib"
  MOD_RES (17)..(17): U(X); wherein 'U' is a natural or unnatural amino acid comprising a functional group covalently attached to the surfactant X
  VARIANT (28)..(28): /replace="Gln"
  source: /note="C-term amide"
  SITE (1)..(29): /note="Variant residues given in the sequence have no preference with respect to those in the annotations for variant positions"
HGQGTFTSDYSKYLDEXAAKEFIQWLLNT

SEQ ID NO: 796 - protein, 29 aa, Artificial Sequence
  source: /note="Description of Artificial Sequence: Synthetic peptide"
  MOD_RES (2)..(2): Aib
  VARIANT (16)..(16): /replace="Glu"
  SITE (16)..(20): /note="Cyclized through side chain to form a lactam linkage"
  VARIANT (20)..(20): /replace="Glu"
  MOD_RES (24)..(24): Lys(N-omega-X)
  VARIANT (28)..(28): /replace="Gln"
  source: /note="C-term amide"
  SITE (1)..(29): /note="Variant residues given in the sequence have no preference with respect to those in the annotations for variant positions"
HXQGTFTSDYSKYLDKQAAKEFIXWLLNT

SEQ ID NO: 797 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(N-omega-X)
  source: /note="C-term amide"
  SITE (1)..(29): /note="Variant residues given in the sequence have no preference with respect to those in the annotations for variant positions"
  source: /note="See specification as filed for detailed description of substitutions and preferred embodiments"
HXQGTFTSDYSKYLDEQAAKEFIXWLLQT

SEQ ID NO: 798 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C9)
  source: /note="C-term amide"
HXQGTFTSDYSKYLDEQAAKEFIXWLLQT

SEQ ID NO: 799 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C10)
  source: /note="C-term amide"
HXQGTFTSDYSKYLDEQAAKEFIXWLLQT

SEQ ID NO: 800 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(C11)
  source: /note="C-term amide"
HXQGTFTSDYSKYLDEQAAKEFIXWLLQT

SEQ ID NO: 801 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(alpha-Me8)
  source: /note="C-term amide"
HXQGTFTSDYSKYLDEQAAKEFIXWLLQT

SEQ ID NO: 802 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(alpha-Me10)
  source: /note="C-term amide"
HXQGTFTSDYSKYLDEQAAKEFIXWLLQT

SEQ ID NO: 803 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(alpha-Me12)
  source: /note="C-term amide"
HXQGTFTSDYSKYLDEQAAKEFIXWLLQT

SEQ ID NO: 804 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(alpha-Me14)
  source: /note="C-term amide"
HXQGTFTSDYSKYLDEQAAKEFIXWLLQT

SEQ ID NO: 805 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(alpha-Me16)
  source: /note="C-term amide"
HXQGTFTSDYSKYLDEQAAKEFIXWLLQT

SEQ ID NO: 806 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(alpha-Me18)
  source: /note="C-term amide"
HXQGTFTSDYSKYLDEQAAKEFIXWLLQT

SEQ ID NO: 807 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me10)
  source: /note="C-term OH"
HXQGTFTSDYSKYLDEQAAKEFIXWLLQT

SEQ ID NO: 808 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me12)
  source: /note="C-term OH"
HXQGTFTSDYSKYLDEQAAKEFIXWLLQT

SEQ ID NO: 809 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me14)
  source: /note="C-term OH"
HXQGTFTSDYSKYLDEQAAKEFIXWLLQT

SEQ ID NO: 810 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me16)
  source: /note="C-term OH"
HXQGTFTSDYSKYLDEQAAKEFIXWLLQT

SEQ ID NO: 811 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me18)
  source: /note="C-term OH"
HXQGTFTSDYSKYLDEQAAKEFIXWLLQT

SEQ ID NO: 812 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me10)
  source: /note="C-term OH"
HXQGTFTSDYSKYLDEEAAKEFIXWLLQT

SEQ ID NO: 813 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me12)
  source: /note="C-term OH"
HXQGTFTSDYSKYLDEEAAKEFIXWLLQT

SEQ ID NO: 814 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me14)
  source: /note="C-term OH"
HXQGTFTSDYSKYLDEEAAKEFIXWLLQT

SEQ ID NO: 815 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me16)
  source: /note="C-term OH"
HXQGTFTSDYSKYLDEEAAKEFIXWLLQT

SEQ ID NO: 816 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me18)
  source: /note="C-term OH"
HXQGTFTSDYSKYLDEEAAKEFIXWLLQT

SEQ ID NO: 817 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(Me10)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 818 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(Me12)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 819 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(Me14)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 820 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(Me16)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 821 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(Me18)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 822 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(Me12)
  SITE (20)..(20): /note="Lys cyclized through side chain to form a lactam linkage"
  source: /note="C-term OH"
HXQGTFTSDYSKYLDEXAAKEFIQWLLQT

SEQ ID NO: 823 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(Me12)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 824 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(Me12)
  SITE (20)..(20): /note="Lys cyclized through side chain to form a lactam linkage"
  source: /note="C-term OH"
HXQGTFTSDYSKYLDEXAAKEFIEWLLQT

SEQ ID NO: 825 - protein, 29 aa, Artificial Sequence
  source: /note="Description of Artificial Sequence: Synthetic peptide"
  MOD_RES (2)..(2): Aib
  MOD_RES (10)..(10): Lys(Me10)
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  source: /note="C-term amide"
HXQGTFTSDXSKYLDEQAAKEFIQWLLQT

SEQ ID NO: 826 - protein, 29 aa, Artificial Sequence
  source: /note="Description of Artificial Sequence: Synthetic peptide"
  MOD_RES (2)..(2): Aib
  MOD_RES (10)..(10): Lys(Me12)
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  source: /note="C-term amide"
HXQGTFTSDXSKYLDEQAAKEFIQWLLQT

SEQ ID NO: 827 - protein, 29 aa, Artificial Sequence
  source: /note="Description of Artificial Sequence: Synthetic peptide"
  MOD_RES (2)..(2): Aib
  MOD_RES (10)..(10): Lys(Me14)
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  source: /note="C-term amide"
HXQGTFTSDXSKYLDEQAAKEFIQWLLQT

SEQ ID NO: 828 - protein, 29 aa, Artificial Sequence
  source: /note="Description of Artificial Sequence: Synthetic peptide"
  MOD_RES (2)..(2): Aib
  MOD_RES (10)..(10): Lys(Me16)
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  source: /note="C-term amide"
HXQGTFTSDXSKYLDEQAAKEFIQWLLQT

SEQ ID NO: 829 - protein, 29 aa, Artificial Sequence
  source: /note="Description of Artificial Sequence: Synthetic peptide"
  MOD_RES (2)..(2): Aib
  MOD_RES (10)..(10): Lys(Me18)
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  source: /note="C-term amide"
HXQGTFTSDXSKYLDEQAAKEFIQWLLQT

SEQ ID NO: 830 - protein, 29 aa, Artificial Sequence
  source: /note="Description of Artificial Sequence: Synthetic peptide"
  MOD_RES (2)..(2): Aib
  MOD_RES (10)..(10): Lys(Me12)
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  source: /note="C-term amide"
HXQGTFTSDXSKYLDEQAAKEFIEWLLQT

SEQ ID NO: 831 - protein, 29 aa, Artificial Sequence
  source: /note="Description of Artificial Sequence: Synthetic peptide"
  MOD_RES (2)..(2): Aib
  MOD_RES (10)..(10): Lys(Me12)
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  source: /note="C-term OH"
HXQGTFTSDXSKYLDEQAAKEFIEWLLQT

SEQ ID NO: 832 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Me10)
  source: /note="C-term amide"
HXQGTFTSDYSKYLDEQAAKEFIXWLLQT

SEQ ID NO: 833 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Me12)
  source: /note="C-term amide"
HXQGTFTSDYSKYLDEQAAKEFIXWLLQT

SEQ ID NO: 834 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Me14)
  source: /note="C-term amide"
HXQGTFTSDYSKYLDEQAAKEFIXWLLQT

SEQ ID NO: 835 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Me16)
  source: /note="C-term amide"
HXQGTFTSDYSKYLDEQAAKEFIXWLLQT

SEQ ID NO: 836 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Me18)
  source: /note="C-term amide"
HXQGTFTSDYSKYLDEQAAKEFIXWLLQT

SEQ ID NO: 837 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Me10)
  source: /note="C-term amide"
HXQGTFTSDYSKYLDEQAAKEFIXWLLQT

SEQ ID NO: 838 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Me12)
  source: /note="C-term amide"
HXQGTFTSDYSKYLDEQAAKEFIXWLLQT

SEQ ID NO: 839 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Me14)
  source: /note="C-term amide"
HXQGTFTSDYSKYLDEQAAKEFIXWLLQT

SEQ ID NO: 840 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Me16)
  source: /note="C-term amide"
HXQGTFTSDYSKYLDEQAAKEFIXWLLQT

SEQ ID NO: 841 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Me18)
  source: /note="C-term amide"
HXQGTFTSDYSKYLDEQAAKEFIXWLLQT

SEQ ID NO: 842 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Me10)
  source: /note="C-term OH"
HXQGTFTSDYSKYLDEQAAKEFIXWLLQT

SEQ ID NO: 843 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Me12)
  source: /note="C-term OH"
HXQGTFTSDYSKYLDEQAAKEFIXWLLQT

SEQ ID NO: 844 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Me14)
  source: /note="C-term OH"
HXQGTFTSDYSKYLDEQAAKEFIXWLLQT

SEQ ID NO: 845 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Me16)
  source: /note="C-term OH"
HXQGTFTSDYSKYLDEQAAKEFIXWLLQT

SEQ ID NO: 846 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Me18)
  source: /note="C-term OH"
HXQGTFTSDYSKYLDEQAAKEFIXWLLQT

SEQ ID NO: 847 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Me10)
  source: /note="C-term OH"
HXQGTFTSDYSKYLDEQAAKEFIXWLLQT

SEQ ID NO: 848 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Me12)
  source: /note="C-term OH"
HXQGTFTSDYSKYLDEQAAKEFIXWLLQT

SEQ ID NO: 849 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Me14)
  source: /note="C-term OH"
HXQGTFTSDYSKYLDEQAAKEFIXWLLQT

SEQ ID NO: 850 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Me16)
  source: /note="C-term OH"
HXQGTFTSDYSKYLDEQAAKEFIXWLLQT

SEQ ID NO: 851 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Me18)
  source: /note="C-term OH"
HXQGTFTSDYSKYLDEQAAKEFIXWLLQT

SEQ ID NO: 852 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Me12)
  source: /note="C-term OH"
HXQGTFTSDYSKYLDEQAAKEFIXWLLQT

SEQ ID NO: 853 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Me10)
  source: /note="C-term OH"
HXQGTFTSDYSKYLDEQAAKEFIXWLLQT

SEQ ID NO: 854 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Me14)
  source: /note="C-term OH"
HXQGTFTSDYSKYLDEQAAKEFIXWLLQT

SEQ ID NO: 855 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Me16)
  source: /note="C-term OH"
HXQGTFTSDYSKYLDEQAAKEFIXWLLQT

SEQ ID NO: 856 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Me18)
  source: /note="C-term OH"
HXQGTFTSDYSKYLDEQAAKEFIXWLLQT

SEQ ID NO: 857 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Me10)
  source: /note="C-term amide"
HXQGTFTSDYSKYLDEQAAKEFIXWLLQT

SEQ ID NO: 858 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Me12)
  source: /note="C-term amide"
HXQGTFTSDYSKYLDEQAAKEFIXWLLQT

SEQ ID NO: 859 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Me14)
  source: /note="C-term amide"
HXQGTFTSDYSKYLDEQAAKEFIXWLLQT

SEQ ID NO: 860 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Me16)
  source: /note="C-term amide"
HXQGTFTSDYSKYLDEQAAKEFIXWLLQT

SEQ ID NO: 861 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Me18)
  source: /note="C-term amide"
HXQGTFTSDYSKYLDEQAAKEFIXWLLQT

SEQ ID NO: 862 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Me18)
  source: /note="C-term amide"
HXQGTFTSDYSKYLDEQAAKEFIXWLLQT

SEQ ID NO: 863 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z8)
  source: /note="C-term PEGa"
HXQGTFTSDYSKYLDEQAAKEFIXWLLQT

SEQ ID NO: 864 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z10)
  source: /note="C-term PEGa"
HXQGTFTSDYSKYLDEQAAKEFIXWLLQT

SEQ ID NO: 865 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z12)
  source: /note="C-term PEGa"
HXQGTFTSDYSKYLDEQAAKEFIXWLLQT

SEQ ID NO: 866 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z14)
  source: /note="C-term PEGa"
HXQGTFTSDYSKYLDEQAAKEFIXWLLQT

SEQ ID NO: 867 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z16)
  source: /note="C-term PEGa"
HXQGTFTSDYSKYLDEQAAKEFIXWLLQT

SEQ ID NO: 868 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z18)
  source: /note="C-term PEGa"
HXQGTFTSDYSKYLDEQAAKEFIXWLLQT

SEQ ID NO: 869 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me8)
  source: /note="C-term PEGa"
HXQGTFTSDYSKYLDEEAAKEFIXWLLQT

SEQ ID NO: 870 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me10)
  source: /note="C-term PEGa"
HXQGTFTSDYSKYLDEEAAKEFIXWLLQT

SEQ ID NO: 871 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me12)
  source: /note="C-term PEGa"
HXQGTFTSDYSKYLDEEAAKEFIXWLLQT

SEQ ID NO: 872 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me14)
  source: /note="C-term PEGa"
HXQGTFTSDYSKYLDEEAAKEFIXWLLQT

SEQ ID NO: 873 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me16)
  source: /note="C-term PEGa"
HXQGTFTSDYSKYLDEEAAKEFIXWLLQT

SEQ ID NO: 874 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me18)
  source: /note="C-term PEGa"
HXQGTFTSDYSKYLDEEAAKEFIXWLLQT

SEQ ID NO: 875 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z8)
  source: /note="C-term PEGb"
HXQGTFTSDYSKYLDEQAAKEFIXWLLQT

SEQ ID NO: 876 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z10)
  source: /note="C-term PEGb"
HXQGTFTSDYSKYLDEQAAKEFIXWLLQT

SEQ ID NO: 877 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z12)
  source: /note="C-term PEGb"
HXQGTFTSDYSKYLDEQAAKEFIXWLLQT

SEQ ID NO: 878 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z14)
  source: /note="C-term PEGb"
HXQGTFTSDYSKYLDEQAAKEFIXWLLQT

SEQ ID NO: 879 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z16)
  source: /note="C-term PEGb"
HXQGTFTSDYSKYLDEQAAKEFIXWLLQT

SEQ ID NO: 880 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z18)
  source: /note="C-term PEGb"
HXQGTFTSDYSKYLDEQAAKEFIXWLLQT

SEQ ID NO: 881 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me8)
  source: /note="C-term PEGb"
HXQGTFTSDYSKYLDEEAAKEFIXWLLQT

SEQ ID NO: 882 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me10)
  source: /note="C-term PEGb"
HXQGTFTSDYSKYLDEEAAKEFIXWLLQT

SEQ ID NO: 883 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me12)
  source: /note="C-term PEGb"
HXQGTFTSDYSKYLDEEAAKEFIXWLLQT

SEQ ID NO: 884 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me14)
  source: /note="C-term PEGb"
HXQGTFTSDYSKYLDEEAAKEFIXWLLQT

SEQ ID NO: 885 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me16)
  source: /note="C-term PEGb"
HXQGTFTSDYSKYLDEEAAKEFIXWLLQT

SEQ ID NO: 886 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me18)
  source: /note="C-term PEGb"
HXQGTFTSDYSKYLDEEAAKEFIXWLLQT

SEQ ID NO: 887 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z8)
  source: /note="C-term PEGc"
HXQGTFTSDYSKYLDEQAAKEFIXWLLQT

SEQ ID NO: 888 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z10)
  source: /note="C-term PEGc"
HXQGTFTSDYSKYLDEQAAKEFIXWLLQT

SEQ ID NO: 889 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z12)
  source: /note="C-term PEGc"
HXQGTFTSDYSKYLDEQAAKEFIXWLLQT

SEQ ID NO: 890 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z14)
  source: /note="C-term PEGc"
HXQGTFTSDYSKYLDEQAAKEFIXWLLQT

SEQ ID NO: 891 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z16)
  source: /note="C-term PEGc"
HXQGTFTSDYSKYLDEQAAKEFIXWLLQT

SEQ ID NO: 892 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z18)
  source: /note="C-term PEGc"
HXQGTFTSDYSKYLDEQAAKEFIXWLLQT

SEQ ID NO: 893 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me8)
  source: /note="C-term PEGc"
HXQGTFTSDYSKYLDEEAAKEFIXWLLQT

SEQ ID NO: 894 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me10)
  source: /note="C-term PEGc"
HXQGTFTSDYSKYLDEEAAKEFIXWLLQT

SEQ ID NO: 895 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me12)
  source: /note="C-term PEGc"
HXQGTFTSDYSKYLDEEAAKEFIXWLLQT

SEQ ID NO: 896 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me14)
  source: /note="C-term PEGc"
HXQGTFTSDYSKYLDEEAAKEFIXWLLQT

SEQ ID NO: 897 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me16)
  source: /note="C-term PEGc"
HXQGTFTSDYSKYLDEEAAKEFIXWLLQT

SEQ ID NO: 898 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me18)
  source: /note="C-term PEGc"
HXQGTFTSDYSKYLDEEAAKEFIXWLLQT

SEQ ID NO: 899 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z8)
  source: /note="C-term PEGd"
HXQGTFTSDYSKYLDEQAAKEFIXWLLQT

SEQ ID NO: 900 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z10)
  source: /note="C-term PEGd"
HXQGTFTSDYSKYLDEQAAKEFIXWLLQT

SEQ ID NO: 901 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z12)
  source: /note="C-term PEGd"
HXQGTFTSDYSKYLDEQAAKEFIXWLLQT

SEQ ID NO: 902 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z14)
  source: /note="C-term PEGd"
HXQGTFTSDYSKYLDEQAAKEFIXWLLQT

SEQ ID NO: 903 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z16)
  source: /note="C-term PEGd"
HXQGTFTSDYSKYLDEQAAKEFIXWLLQT

SEQ ID NO: 904 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z18)
  source: /note="C-term PEGd"
HXQGTFTSDYSKYLDEQAAKEFIXWLLQT

SEQ ID NO: 905 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me8)
  source: /note="C-term PEGd"
HXQGTFTSDYSKYLDEEAAKEFIXWLLQT

SEQ ID NO: 906 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me10)
  source: /note="C-term PEGd"
HXQGTFTSDYSKYLDEEAAKEFIXWLLQT

SEQ ID NO: 907 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me12)
  source: /note="C-term PEGd"
HXQGTFTSDYSKYLDEEAAKEFIXWLLQT

SEQ ID NO: 908 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me14)
  source: /note="C-term PEGd"
HXQGTFTSDYSKYLDEEAAKEFIXWLLQT

SEQ ID NO: 909 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me16)
  source: /note="C-term PEGd"
HXQGTFTSDYSKYLDEEAAKEFIXWLLQT

SEQ ID NO: 910 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Me18)
  source: /note="C-term PEGd"
HXQGTFTSDYSKYLDEEAAKEFIXWLLQT

SEQ ID NO: 911 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z8)
  source: /note="C-term OH"
HXQGTFTSDYSKYLDEQAAKEFIXWLLQT

SEQ ID NO: 912 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z10)
  source: /note="C-term OH"
HXQGTFTSDYSKYLDEQAAKEFIXWLLQT

SEQ ID NO: 913 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z12)
  source: /note="C-term OH"
HXQGTFTSDYSKYLDEQAAKEFIXWLLQT

SEQ ID NO: 914 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z14)
  source: /note="C-term OH"
HXQGTFTSDYSKYLDEQAAKEFIXWLLQT

SEQ ID NO: 915 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z16)
  source: /note="C-term OH"
HXQGTFTSDYSKYLDEQAAKEFIXWLLQT

SEQ ID NO: 916 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z18)
  source: /note="C-term OH"
HXQGTFTSDYSKYLDEQAAKEFIXWLLQT

SEQ ID NO: 917 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z8)
  source: /note="C-term OH"
HXQGTFTSDYSKYLDEEAAKEFIXWLLQT

SEQ ID NO: 918 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z10)
  source: /note="C-term OH"
HXQGTFTSDYSKYLDEEAAKEFIXWLLQT

SEQ ID NO: 919 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z12)
  source: /note="C-term OH"
HXQGTFTSDYSKYLDEEAAKEFIXWLLQT

SEQ ID NO: 920 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z14)
  source: /note="C-term OH"
HXQGTFTSDYSKYLDEEAAKEFIXWLLQT

SEQ ID NO: 921 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z16)
  source: /note="C-term OH"
HXQGTFTSDYSKYLDEEAAKEFIXWLLQT

SEQ ID NO: 922 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(Z18)
  source: /note="C-term OH"
HXQGTFTSDYSKYLDEEAAKEFIXWLLQT

SEQ ID NO: 923 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Z8)
  source: /note="C-term OH"
HXQGTFTSDYSKYLDEQAAKEFIXWLLQT

SEQ ID NO: 924 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Z10)
  source: /note="C-term OH"
HXQGTFTSDYSKYLDEQAAKEFIXWLLQT

SEQ ID NO: 925 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Z12)
  source: /note="C-term OH"
HXQGTFTSDYSKYLDEQAAKEFIXWLLQT

SEQ ID NO: 926 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Z14)
  source: /note="C-term OH"
HXQGTFTSDYSKYLDEQAAKEFIXWLLQT

SEQ ID NO: 927 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Z16)
  source: /note="C-term OH"
HXQGTFTSDYSKYLDEQAAKEFIXWLLQT

SEQ ID NO: 928 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Z18)
  source: /note="C-term OH"
HXQGTFTSDYSKYLDEQAAKEFIXWLLQT

SEQ ID NO: 929 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Z8)
  source: /note="C-term OH"
HXQGTFTSDYSKYLDEQAAKEFIXWLLQT

SEQ ID NO: 930 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Z10)
  source: /note="C-term OH"
HXQGTFTSDYSKYLDEQAAKEFIXWLLQT

SEQ ID NO: 931 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Z12)
  source: /note="C-term OH"
HXQGTFTSDYSKYLDEQAAKEFIXWLLQT

SEQ ID NO: 932 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Z14)
  source: /note="C-term OH"
HXQGTFTSDYSKYLDEQAAKEFIXWLLQT

SEQ ID NO: 933 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Z16)
  source: /note="C-term OH"
HXQGTFTSDYSKYLDEQAAKEFIXWLLQT

SEQ ID NO: 934 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Z18)
  source: /note="C-term OH"
HXQGTFTSDYSKYLDEQAAKEFIXWLLQT

SEQ ID NO: 935 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Z8)
  source: /note="C-term OH"
HXQGTFTSDYSKYLDEQAAKEFIXWLLQT

SEQ ID NO: 936 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Z10)
  source: /note="C-term OH"
HXQGTFTSDYSKYLDEQAAKEFIXWLLQT

SEQ ID NO: 937 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Z12)
  source: /note="C-term OH"
HXQGTFTSDYSKYLDEQAAKEFIXWLLQT

SEQ ID NO: 938 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Z14)
  source: /note="C-term OH"
HXQGTFTSDYSKYLDEQAAKEFIXWLLQT

SEQ ID NO: 939 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Z16)
  source: /note="C-term OH"
HXQGTFTSDYSKYLDEQAAKEFIXWLLQT

SEQ ID NO: 940 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Z18)
  source: /note="C-term OH"
HXQGTFTSDYSKYLDEQAAKEFIXWLLQT

SEQ ID NO: 941 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Z8)
  source: /note="C-term amide"
HXQGTFTSDYSKYLDEQAAKEFIXWLLQT

SEQ ID NO: 942 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Z10)
  source: /note="C-term amide"
HXQGTFTSDYSKYLDEQAAKEFIXWLLQT

SEQ ID NO: 943 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Z12)
  source: /note="C-term amide"
HXQGTFTSDYSKYLDEQAAKEFIXWLLQT

SEQ ID NO: 944 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Z14)
  source: /note="C-term amide"
HXQGTFTSDYSKYLDEQAAKEFIXWLLQT

SEQ ID NO: 945 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Z16)
  source: /note="C-term amide"
HXQGTFTSDYSKYLDEQAAKEFIXWLLQT

SEQ ID NO: 946 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS1(Z18)
  source: /note="C-term amide"
HXQGTFTSDYSKYLDEQAAKEFIXWLLQT

SEQ ID NO: 947 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Z8)
  source: /note="C-term amide"
HXQGTFTSDYSKYLDEQAAKEFIXWLLQT

SEQ ID NO: 948 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Z10)
  source: /note="C-term amide"
HXQGTFTSDYSKYLDEQAAKEFIXWLLQT

SEQ ID NO: 949 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Z12)
  source: /note="C-term amide"
HXQGTFTSDYSKYLDEQAAKEFIXWLLQT

SEQ ID NO: 950 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Z14)
  source: /note="C-term amide"
HXQGTFTSDYSKYLDEQAAKEFIXWLLQT

SEQ ID NO: 951 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Z16)
  source: /note="C-term amide"
HXQGTFTSDYSKYLDEQAAKEFIXWLLQT

SEQ ID NO: 952 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS2(Z18)
  source: /note="C-term amide"
HXQGTFTSDYSKYLDEQAAKEFIXWLLQT

SEQ ID NO: 953 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Z8)
  source: /note="C-term amide"
HXQGTFTSDYSKYLDEQAAKEFIXWLLQT

SEQ ID NO: 954 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Z10)
  source: /note="C-term amide"
HXQGTFTSDYSKYLDEQAAKEFIXWLLQT

SEQ ID NO: 955 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Z12)
  source: /note="C-term amide"
HXQGTFTSDYSKYLDEQAAKEFIXWLLQT

SEQ ID NO: 956 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Z14)
  source: /note="C-term amide"
HXQGTFTSDYSKYLDEQAAKEFIXWLLQT

SEQ ID NO: 957 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Z16)
  source: /note="C-term amide"
HXQGTFTSDYSKYLDEQAAKEFIXWLLQT

SEQ ID NO: 958 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): LysS3(Z18)
  source: /note="C-term amide"
HXQGTFTSDYSKYLDEQAAKEFIXWLLQT

SEQ ID NO: 959 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Me10)
  source: /note="C-term amide"
HXQGTFTSDESKYKDSQAAXEFIQWLLQT

SEQ ID NO: 960 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Me12)
  source: /note="C-term amide"
HXQGTFTSDESKYKDSQAAXEFIQWLLQT

SEQ ID NO: 961 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Me14)
  source: /note="C-term amide"
HXQGTFTSDESKYKDSQAAXEFIQWLLQT

SEQ ID NO: 962 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Me16)
  source: /note="C-term amide"
HXQGTFTSDESKYKDSQAAXEFIQWLLQT

SEQ ID NO: 963 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Me18)
  source: /note="C-term amide"
HXQGTFTSDESKYKDSQAAXEFIQWLLQT

SEQ ID NO: 964 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Z10)
  source: /note="C-term amide"
HXQGTFTSDESKYKDSQAAXEFIQWLLQT

SEQ ID NO: 965 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Z12)
  source: /note="C-term amide"
HXQGTFTSDESKYKDSQAAXEFIQWLLQT

SEQ ID NO: 966 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Z14)
  source: /note="C-term amide"
HXQGTFTSDESKYKDSQAAXEFIQWLLQT

SEQ ID NO: 967 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Z16)
  source: /note="C-term amide"
HXQGTFTSDESKYKDSQAAXEFIQWLLQT

SEQ ID NO: 968 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Z18)
  source: /note="C-term amide"
HXQGTFTSDESKYKDSQAAXEFIQWLLQT

SEQ ID NO: 969 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): Lys(Me10)
  source: /note="C-term amide"
HXQGTFTSDYSEYLDKQAAXEFIQWLLQT

SEQ ID NO: 970 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): Lys(Me12)
  source: /note="C-term amide"
HXQGTFTSDYSEYLDKQAAXEFIQWLLQT

SEQ ID NO: 971 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): Lys(Me14)
  source: /note="C-term amide"
HXQGTFTSDYSEYLDKQAAXEFIQWLLQT

SEQ ID NO: 972 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): Lys(Me16)
  source: /note="C-term amide"
HXQGTFTSDYSEYLDKQAAXEFIQWLLQT

SEQ ID NO: 973 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): Lys(Me18)
  source: /note="C-term amide"
HXQGTFTSDYSEYLDKQAAXEFIQWLLQT

SEQ ID NO: 974 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): Lys(Z10)
  source: /note="C-term amide"
HXQGTFTSDYSEYLDKQAAXEFIQWLLQT

SEQ ID NO: 975 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): Lys(Z12)
  source: /note="C-term amide"
HXQGTFTSDYSEYLDKQAAXEFIQWLLQT

SEQ ID NO: 976 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): Lys(Z14)
  source: /note="C-term amide"
HXQGTFTSDYSEYLDKQAAXEFIQWLLQT

SEQ ID NO: 977 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): Lys(Z16)
  source: /note="C-term amide"
HXQGTFTSDYSEYLDKQAAXEFIQWLLQT

SEQ ID NO: 978 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): Lys(Z18)
  source: /note="C-term amide"
HXQGTFTSDYSEYLDKQAAXEFIQWLLQT

SEQ ID NO: 979 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS1(Me10)
  source: /note="C-term amide"
HXQGTFTSDESKYKDSQAAXEFIQWLLQT

SEQ ID NO: 980 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS1(Me12)
  source: /note="C-term amide"
HXQGTFTSDESKYKDSQAAXEFIQWLLQT

SEQ ID NO: 981 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS1(Me14)
  source: /note="C-term amide"
HXQGTFTSDESKYKDSQAAXEFIQWLLQT

SEQ ID NO: 982 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS1(Me16)
  source: /note="C-term amide"
HXQGTFTSDESKYKDSQAAXEFIQWLLQT

SEQ ID NO: 983 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS1(Me18)
  source: /note="C-term amide"
HXQGTFTSDESKYKDSQAAXEFIQWLLQT

SEQ ID NO: 984 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS2(Me10)
  source: /note="C-term amide"
HXQGTFTSDESKYKDSQAAXEFIQWLLQT

SEQ ID NO: 985 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS2(Me12)
  source: /note="C-term amide"
HXQGTFTSDESKYKDSQAAXEFIQWLLQT

SEQ ID NO: 986 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS3(Me14)
  source: /note="C-term amide"
HXQGTFTSDESKYKDSQAAXEFIQWLLQT

SEQ ID NO: 987 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS3(Me16)
  source: /note="C-term amide"
HXQGTFTSDESKYKDSQAAXEFIQWLLQT

SEQ ID NO: 988 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS2(Me18)
  source: /note="C-term amide"
HXQGTFTSDESKYKDSQAAXEFIQWLLQT

SEQ ID NO: 989 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS2(Me14)
  source: /note="C-term amide"
HXQGTFTSDESKYKDSQAAXEFIQWLLQT

SEQ ID NO: 990 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS2(Me16)
  source: /note="C-term amide"
HXQGTFTSDESKYKDSQAAXEFIQWLLQT

SEQ ID NO: 991 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS1(Z10)
  source: /note="C-term amide"
HXQGTFTSDESKYKDSQAAXEFIQWLLQT

SEQ ID NO: 992 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS1(Z12)
  source: /note="C-term amide"
HXQGTFTSDESKYKDSQAAXEFIQWLLQT

SEQ ID NO: 993 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS1(Z14)
  source: /note="C-term amide"
HXQGTFTSDESKYKDSQAAXEFIQWLLQT

SEQ ID NO: 994 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS1(Z16)
  source: /note="C-term amide"
HXQGTFTSDESKYKDSQAAXEFIQWLLQT

SEQ ID NO: 995 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS1(Z18)
  source: /note="C-term amide"
HXQGTFTSDESKYKDSQAAXEFIQWLLQT

SEQ ID NO: 996 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS2(Z14)
  source: /note="C-term amide"
HXQGTFTSDESKYKDSQAAXEFIQWLLQT

SEQ ID NO: 997 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS2(Z16)
  source: /note="C-term amide"
HXQGTFTSDESKYKDSQAAXEFIQWLLQT

SEQ ID NO: 998 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS2(Z18)
  source: /note="C-term amide"
HXQGTFTSDESKYKDSQAAXEFIQWLLQT

SEQ ID NO: 999 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS3(Z14)
  source: /note="C-term amide"
HXQGTFTSDESKYKDSQAAXEFIQWLLQT

SEQ ID NO: 1000 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS3(Z16)
  source: /note="C-term amide"
HXQGTFTSDESKYKDSQAAXEFIQWLLQT

SEQ ID NO: 1001 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): LysS3(Z18)
  source: /note="C-term amide"
HXQGTFTSDESKYKDSQAAXEFIQWLLQT

SEQ ID NO: 1002 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS1(Me10)
  source: /note="C-term amide"
HXQGTFTSDYSEYLDKQAAXEFIQWLLQT

SEQ ID NO: 1003 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS1(Me12)
  source: /note="C-term amide"
HXQGTFTSDYSEYLDKQAAXEFIQWLLQT

SEQ ID NO: 1004 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS1(Me14)
  source: /note="C-term amide"
HXQGTFTSDYSEYLDKQAAXEFIQWLLQT

SEQ ID NO: 1005 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS1(Me16)
  source: /note="C-term amide"
HXQGTFTSDYSEYLDKQAAXEFIQWLLQT

SEQ ID NO: 1006 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS1(Me18)
  source: /note="C-term amide"
HXQGTFTSDYSEYLDKQAAXEFIQWLLQT

SEQ ID NO: 1007 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS2(Me10)
  source: /note="C-term amide"
HXQGTFTSDYSEYLDKQAAXEFIQWLLQT

SEQ ID NO: 1008 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS2(Me12)
  source: /note="C-term amide"
HXQGTFTSDYSEYLDKQAAXEFIQWLLQT

SEQ ID NO: 1009 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS3(Me14)
  source: /note="C-term amide"
HXQGTFTSDYSEYLDKQAAXEFIQWLLQT

SEQ ID NO: 1010 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS3(Me16)
  source: /note="C-term amide"
HXQGTFTSDYSEYLDKQAAXEFIQWLLQT

SEQ ID NO: 1011 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS2(Me18)
  source: /note="C-term amide"
HXQGTFTSDYSEYLDKQAAXEFIQWLLQT

SEQ ID NO: 1012 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS2(Me14)
  source: /note="C-term amide"
HXQGTFTSDYSEYLDKQAAXEFIQWLLQT

SEQ ID NO: 1013 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS2(Me16)
  source: /note="C-term amide"
HXQGTFTSDYSEYLDKQAAXEFIQWLLQT

SEQ ID NO: 1014 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS1(Z10)
  source: /note="C-term amide"
HXQGTFTSDYSEYLDKQAAXEFIQWLLQT

SEQ ID NO: 1015 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS1(Z12)
  source: /note="C-term amide"
HXQGTFTSDYSEYLDKQAAXEFIQWLLQT

SEQ ID NO: 1016 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS1(Z14)
  source: /note="C-term amide"
HXQGTFTSDYSEYLDKQAAXEFIQWLLQT

SEQ ID NO: 1017 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS1(Z16)
  source: /note="C-term amide"
HXQGTFTSDYSEYLDKQAAXEFIQWLLQT

SEQ ID NO: 1018 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS1(Z18)
  source: /note="C-term amide"
HXQGTFTSDYSEYLDKQAAXEFIQWLLQT

SEQ ID NO: 1019 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS2(Z14)
  source: /note="C-term amide"
HXQGTFTSDYSEYLDKQAAXEFIQWLLQT

SEQ ID NO: 1020 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS2(Z16)
  source: /note="C-term amide"
HXQGTFTSDYSEYLDKQAAXEFIQWLLQT

SEQ ID NO: 1021 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS2(Z18)
  source: /note="C-term amide"
HXQGTFTSDYSEYLDKQAAXEFIQWLLQT

SEQ ID NO: 1022 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS3(Z14)
  source: /note="C-term amide"
HXQGTFTSDYSEYLDKQAAXEFIQWLLQT

SEQ ID NO: 1023 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS3(Z16)
  source: /note="C-term amide"
HXQGTFTSDYSEYLDKQAAXEFIQWLLQT

SEQ ID NO: 1024 - protein, 29 aa, Artificial Sequence
  source: /note="Description of Artificial Sequence: Synthetic peptide"
  MOD_RES (2)..(2): Aib
  SITE (12)..(16): /note="Cyclic"
  SITE (12)..(12): /note="Glu cyclized through side chain to form a lactam linkage"
  SITE (16)..(16): /note="Lys cyclized through side chain to form a lactam linkage"
  MOD_RES (20)..(20): LysS3(Z18)
  source: /note="C-term amide"
HXQGTFTSDYSEYLDKQAAXEFIQWLLQT

SEQ ID NO: 1025 - protein, 29 aa, Artificial Sequence
  source: /note="Description of Artificial Sequence: Synthetic peptide"
  MOD_RES (2)..(2): Aib
  MOD_RES (10)..(10): U(X); wherein 'U' is a natural or unnatural amino acid comprising a functional group covalently attached to the surfactant X
  SITE (16)..(20): /note="Cyclic"
  VARIANT (16)..(16): /replace="Glu"
  SITE (16)..(20): /note="Cyclized through side chain to form a lactam linkage"
  VARIANT (17)..(17): /replace="Gln"
  VARIANT (20)..(20): /replace="Glu"
  VARIANT (24)..(24): /replace="Glu" or "Gln"
  VARIANT (28)..(28): /replace="Gln"
  source: /note="C-term -OH or NH-R3"
  SITE (1)..(29): /note="Variant residues given in the sequence have no preference with respect to those in the annotations for variant positions"
HXQGTFTSDXSKYLDKEAAKEFIAWLLNT

SEQ ID NO: 1026 - protein, 29 aa, Artificial Sequence
  source: /note="Description of Artificial Sequence: Synthetic peptide"
  MOD_RES (2)..(2): Aib
  SITE (16)..(20): /note="Cyclic"
  VARIANT (16)..(16): /replace="Glu"
  SITE (16)..(20): /note="Cyclized through side chain to form a lactam linkage"
  MOD_RES (17)..(17): U(X); wherein 'U' is a natural or unnatural amino acid comprising a functional group covalently attached to the surfactant X
  VARIANT (20)..(20): /replace="Glu"
  VARIANT (24)..(24): /replace="Glu" or "Gln"
  VARIANT (28)..(28): /replace="Gln"
  source: /note="C-term -OH or NH-R3"
  SITE (1)..(29): /note="Variant residues given in the sequence have no preference with respect to those in the annotations for variant positions"
HXQGTFTSDYSKYLDKXAAKEFIAWLLNT

SEQ ID NO: 1027 - protein, 29 aa, Artificial Sequence
  source: /note="Description of Artificial Sequence: Synthetic peptide"
  MOD_RES (2)..(2): Aib
  SITE (10)..(14): /note="Cyclic"
  VARIANT (10)..(10): /replace="Glu"
  SITE (10)..(14): /note="Cyclized through side chain to form a lactam linkage"
  VARIANT (14)..(14): /replace="Glu"
  VARIANT (17)..(17): /replace="Gln"
  MOD_RES (20)..(20): U(X); wherein 'U' is a natural or unnatural amino acid comprising a functional group covalently attached to the surfactant X
  VARIANT (24)..(24): /replace="Glu" or "Gln"
  VARIANT (28)..(28): /replace="Gln"
  source: /note="C-term -OH or NH-R3"
  SITE (1)..(29): /note="Variant residues given in the sequence have no preference with respect to those in the annotations for variant positions"
HXQGTFTSDKSKYKDSEAAXEFIAWLLNT

SEQ ID NO: 1028 - protein, 29 aa, Artificial Sequence
  source: /note="Description of Artificial Sequence: Synthetic peptide"
  MOD_RES (2)..(2): Aib
  SITE (12)..(16): /note="Cyclic"
  VARIANT (12)..(12): /replace="Glu"
  SITE (12)..(16): /note="Cyclized through side chain to form a lactam linkage"
  VARIANT (16)..(16): /replace="Glu"
  VARIANT (17)..(17): /replace="Gln"
  MOD_RES (20)..(20): U(X); wherein 'U' is a natural or unnatural amino acid comprising a functional group covalently attached to the surfactant X
  VARIANT (24)..(24): /replace="Glu" or "Gln"
  VARIANT (28)..(28): /replace="Gln"
  source: /note="C-term -OH or NH-R3"
  SITE (1)..(29): /note="Variant residues given in the sequence have no preference with respect to those in the annotations for variant positions"
HXQGTFTSDYSKYQDKEAAXEFIAWLLNT

SEQ ID NO: 1029 - protein, 29 aa, Artificial Sequence
  source: /note="Description of Artificial Sequence: Synthetic peptide"
  MOD_RES (2)..(2): Aib
  SITE (16)..(20): /note="Cyclic"
  VARIANT (16)..(16): /replace="Glu"
  SITE (16)..(20): /note="Cyclized through side chain to form a lactam linkage"
  VARIANT (20)..(20): /replace="Glu"
  MOD_RES (24)..(24): U(X); wherein 'U' is a natural or unnatural amino acid comprising a functional group covalently attached to the surfactant X
  VARIANT (28)..(28): /replace="Gln"
  source: /note="C-term -OH or NH-R3"
  SITE (1)..(29): /note="Variant residues given in the sequence have no preference with respect to those in the annotations for variant positions"
HXQGTFTSDYSKYLDKQAAKEFIXWLLNT

SEQ ID NO: 1030 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS1(Me10)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1031 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS1(Me12)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1032 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS1(Me14)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1033 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS1(Me16)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1034 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS1(Me18)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1035 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS1(Me14)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1036 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS1(Me16)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1037 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS1(Me18)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1038 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS2(Me10)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1039 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS2(Me12)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1040 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS2(Me14)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1041 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS2(Me16)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1042 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS2(Me18)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1043 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS2(Me14)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1044 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS2(Me16)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1045 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS2(Me18)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1046 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS3(Me10)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1047 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS3(Me12)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1048 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS3(Me14)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1049 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS3(Me16)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1050 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS3(Me18)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1051 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS3(Me14)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1052 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS3(Me16)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1053 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS3(Me18)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1054 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS1(Z10)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1055 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS1(Z12)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1056 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS1(Z14)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1057 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS1(Z16)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1058 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS1(Z18)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1059 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS1(Z16)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1060 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS1(Z18)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1061 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS2(Z10)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1062 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS2(Z12)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1063 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS2(Z14)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1064 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS2(Z16)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1065 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS2(Z18)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1066 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS2(Z16)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1067 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS2(Z18)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1068 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS3(Z10)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1069 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS3(Z12)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1070 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS3(Z14)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1071 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS3(Z16)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1072 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS3(Z18)
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1073 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS3(Z16)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1074 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): LysS3(Z18)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1075 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(Me14)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1076 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(Me16)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1077 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(Me18)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1078 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(Z14)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1079 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(Z16)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1080 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(Z18)
  SITE (20)..(20): /note="Lys cyclized through side chain to form a lactam linkage"
  source: /note="C-term amide"
HXQGTFTSDYSKYLDEXAAKEFIEWLLQT

SEQ ID NO: 1081 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Me14)
  source: /note="C-term amide"
HXQGTFTSDESKYKDSQAAXEFIEWLLQT

SEQ ID NO: 1082 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Me16)
  source: /note="C-term amide"
HXQGTFTSDESKYKDSQAAXEFIEWLLQT

SEQ ID NO: 1083 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Me18)
  source: /note="C-term amide"
HXQGTFTSDESKYKDSQAAXEFIEWLLQT

SEQ ID NO: 1084 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Z14)
  source: /note="C-term amide"
HXQGTFTSDESKYKDSQAAXEFIEWLLQT

SEQ ID NO: 1085 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Z16)
  source: /note="C-term amide"
HXQGTFTSDESKYKDSQAAXEFIEWLLQT

SEQ ID NO: 1086 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Z18)
  source: /note="C-term amide"
HXQGTFTSDESKYKDSQAAXEFIEWLLQT

SEQ ID NO: 1087 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Me14)
  source: /note="C-term amide"
HXQGTFTSDESKYKDSEAAXEFIEWLLQT

SEQ ID NO: 1088 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Me16)
  source: /note="C-term amide"
HXQGTFTSDESKYKDSEAAXEFIEWLLQT

SEQ ID NO: 1089 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Me18)
  source: /note="C-term amide"
HXQGTFTSDESKYKDSEAAXEFIEWLLQT

SEQ ID NO: 1090 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Z14)
  source: /note="C-term amide"
HXQGTFTSDESKYKDSEAAXEFIEWLLQT

SEQ ID NO: 1091 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Z16)
  source: /note="C-term amide"
HXQGTFTSDESKYKDSEAAXEFIEWLLQT

SEQ ID NO: 1092 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Z18)
  source: /note="C-term amide"
HXQGTFTSDESKYKDSEAAXEFIEWLLQT

SEQ ID NO: 1093 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Me14)
  source: /note="C-term amide"
HXQGTFTSDESKYKDSEAAXEFIQWLLQT

SEQ ID NO: 1094 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Me16)
  source: /note="C-term amide"
HXQGTFTSDESKYKDSEAAXEFIQWLLQT

SEQ ID NO: 1095 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Me18)
  source: /note="C-term amide"
HXQGTFTSDESKYKDSEAAXEFIQWLLQT

SEQ ID NO: 1096 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Z14)
  source: /note="C-term amide"
HXQGTFTSDESKYKDSEAAXEFIQWLLQT

SEQ ID NO: 1097 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Z16)
  source: /note="C-term amide"
HXQGTFTSDESKYKDSEAAXEFIQWLLQT

SEQ ID NO: 1098 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (20)..(20): Lys(Z18)
  source: /note="C-term amide"
HXQGTFTSDESKYKDSEAAXEFIQWLLQT

SEQ ID NO: 1099 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (17)..(17): Lys(Z12)
  MOD_RES (24)..(24): Lys(Z12)
  source: /note="C-term amide"
HXQGTFTSDESKYKDSXAAQEFIXWLLQT

SEQ ID NO: 1100 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (17)..(17): Lys(Z14)
  MOD_RES (24)..(24): Lys(Z14)
  source: /note="C-term amide"
HXQGTFTSDESKYKDSXAAQEFIXWLLQT

SEQ ID NO: 1101 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (17)..(17): Lys(Z16)
  MOD_RES (24)..(24): Lys(Z16)
  source: /note="C-term amide"
HXQGTFTSDESKYKDSXAAQEFIXWLLQT

SEQ ID NO: 1102 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (17)..(17): Lys(Z14CO2)
  source: /note="C-term amide"
HXQGTFTSDESKYKDSXAAQEFIQWLLQT

SEQ ID NO: 1103 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (17)..(17): Lys(Z16CO2)
  source: /note="C-term amide"
HXQGTFTSDESKYKDSXAAQEFIQWLLQT

SEQ ID NO: 1104 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (17)..(17): Lys(Z18CO2)
  source: /note="C-term amide"
HXQGTFTSDESKYKDSXAAQEFIQWLLQT

SEQ ID NO: 1105 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (24)..(24): Lys(Z14CO2)
  source: /note="C-term amide"
HXQGTFTSDESKYKDSQAAQEFIXWLLQT

SEQ ID NO: 1106 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (24)..(24): Lys(Z16CO2)
  source: /note="C-term amide"
HXQGTFTSDESKYKDSQAAQEFIXWLLQT

SEQ ID NO: 1107 - protein, 29 aa, Artificial Sequence
  source: /note="Description of Artificial Sequence: Synthetic peptide"
  MOD_RES (2)..(2): Aib
  SITE (10)..(14): /note="Cyclic"
  SITE (10)..(10): /note="Glu cyclized through side chain to form a lactam linkage"
  SITE (14)..(14): /note="Lys cyclized through side chain to form a lactam linkage"
  MOD_RES (24)..(24): Lys(Z18CO2)
  source: /note="C-term amide"
HXQGTFTSDESKYKDSQAAQEFIXWLLQT

SEQ ID NO: 1108 - protein, 38 aa, Artificial Sequence
  source: /note="Description of Artificial Sequence: Synthetic polypeptide"
  MOD_RES (1)..(1): pGlu
  VARIANT (1)..(1): /replace=" "
  VARIANT (2)..(2): /replace="N(R3)His" or "N(R4)His"
  VARIANT (3)..(3): /replace="D-Ser" or "Ala" or "Gly" or "Pro" or "MePro" or "Aib" or "Ac4c" or "Ac5c"
  VARIANT (4)..(4): /replace="Cit"
  VARIANT (5)..(5): /replace="D-Ala"
  VARIANT (6)..(6): /replace="Ser"
  VARIANT (7)..(7): /replace="Trp" or "2FPhe" or "MePhe" or "2FMePhe" or "Nal2"
  VARIANT (8)..(8): /replace="Ser"
  VARIANT (9)..(9): /replace="Asp"
  VARIANT (10)..(10): /replace="Glu"
  VARIANT (11)..(11): /replace="Leu" or "Met" or "Nal2" or "Bip" or "Bip2EtMeO" or "Glu" or "Lys" or "U; wherein 'U' is any natural or unnatural amino acid comprising a functional group used for covalent attachment to the surfactant X"
  VARIANT (12)..(12): /replace="Asn" or "Bip" or "U; wherein 'U' is any natural or unnatural amino acid comprising a functional group used for covalent attachment to the surfactant X" or " "
  VARIANT (13)..(13): /replace="Glu" or "Ser" or "Arg" or "U; wherein 'U' is any natural or unnatural amino acid comprising a functional group used for covalent attachment to the surfactant X" or " "
  VARIANT (14)..(14): /replace="Gln" or "Cit" or "U; wherein 'U' is any natural or unnatural amino acid comprising a functional group used for covalent attachment to the surfactant X" or " "
  VARIANT (15)..(15): /replace="Met" or "Nle" or "Glu" or "Lys" or "U; wherein 'U' is any natural or unnatural amino acid comprising a functional group used for covalent attachment to the surfactant X" or " "
  VARIANT (16)..(16): /replace="Glu" or "U; wherein 'U' is any natural or unnatural amino acid comprising a functional group used for covalent attachment to the surfactant X" or " "
  VARIANT (17)..(17): /replace="Gly" or "Glu" or "Ala" or "Aib" or "Ac5c" or "Lys" or "Arg" or "U; wherein 'U' is any natural or unnatural amino acid comprising a functional group used for covalent attachment to the surfactant X" or " "
  VARIANT (18)..(18): /replace="hArg" or "Gln" or "Glu" or "Cit" or "Aib" or "Ac4c" or "Ac5c" or "Lys" or "U; wherein 'U' is any natural or unnatural amino acid comprising a functional group used for covalent attachment to the surfactant X" or " "
  VARIANT (19)..(19): /replace="hArg" or "Ala" or "Aib" or "Ac4c" or "Ac5c" or "U; wherein 'U' is any natural or unnatural amino acid comprising a functional group used for covalent attachment to the surfactant X" or " "
  VARIANT (20)..(20): /replace="Val" or "Aib" or "Ac4c" or "Ac5c" or "U; wherein 'U' is any natural or unnatural amino acid comprising a functional group used for covalent attachment to the surfactant X" or " "
  VARIANT (21)..(21): /replace="Lys" or "Arg" or "Cit" or "Glu" or "Aib" or "Ac4c" or "Ac5c" or "U; wherein 'U' is any natural or unnatural amino acid comprising a functional group used for covalent attachment to the surfactant X" or " "
  VARIANT (22)..(22): /replace="Glu" or "Leu" or "Aib" or "Ac4c" or "Ac5c" or "U; wherein 'U' is any natural or unnatural amino acid comprising a functional group used for covalent attachment to the surfactant X" or " "
  VARIANT (23)..(23): /replace="Trp" or "Nal2" or "Aib" or "Ac4c" or "Ac5c" or "U; wherein 'U' is any natural or unnatural amino acid comprising a functional group used for covalent attachment to the surfactant X" or " "
  VARIANT (24)..(24): /replace="Ile" or "Aib" or "Ac4c" or "Ac5c" or "U; wherein 'U' is any natural or unnatural amino acid comprising a functional group used for covalent attachment to the surfactant X" or " "
  VARIANT (25)..(25): /replace="Ala" or "Glu" or "Cit" or "U; wherein 'U' is any natural or unnatural amino acid comprising a functional group used for covalent attachment to the surfactant X" or " "
  VARIANT (26)..(26): /replace="Nal2" or "U; wherein 'U' is any natural or unnatural amino acid comprising a functional group used for covalent attachment to the surfactant X" or " "
  VARIANT (27)..(27): /replace="U; wherein 'U' is any natural or unnatural amino acid comprising a functional group used for covalent attachment to the surfactant X" or " "
  VARIANT (28)..(28): /replace="Val" or "Leu" or "Nle" or "Lys" or "U; wherein 'U' is any natural or unnatural amino acid comprising a functional group used for covalent attachment to the surfactant X" or " "
  VARIANT (29)..(29): /replace="Lys" or "Glu" or "Gln" or "Cit" or "U; wherein 'U' is any natural or unnatural amino acid comprising a functional group used for covalent attachment to the surfactant X" or " "
  VARIANT (30)..(30): /replace="Gly" or "Aib" or "Ac4c" or "Ac5c" or "U; wherein 'U' is any natural or unnatural amino acid comprising a functional group used for covalent attachment to the surfactant X" or " "
  VARIANT (31)..(31): /replace="Aib" or "Ac4c" or "Ac5c" or "Arg" or "U; wherein 'U' is any natural or unnatural amino acid comprising a functional group used for covalent attachment to the surfactant X" or " "
  VARIANT (32)..(32): /replace="Aib" or "Ac4c" or "Ac5c" or "U; wherein 'U' is any natural or unnatural amino acid comprising a functional group used for covalent attachment to the surfactant X" or " "
  VARIANT (33)..(33): /replace="Aib" or "Ac4c" or "Ac5c" or "U; wherein 'U' is any natural or unnatural amino acid comprising a functional group used for covalent attachment to the surfactant X" or " "
  VARIANT (34)..(34): /replace="Aib" or "Ac4c" or "Ac5c" or "U; wherein 'U' is any natural or unnatural amino acid comprising a functional group used for covalent attachment to the surfactant X" or " "
  VARIANT (35)..(35): /replace="Aib" or "Ac4c" or "Ac5c" or "U; wherein 'U' is any natural or unnatural amino acid comprising a functional group used for covalent attachment to the surfactant X" or " "
  VARIANT (36)..(36): /replace="Aib" or "Ac4c" or "Ac5c" or "U; wherein 'U' is any natural or unnatural amino acid comprising a functional group used for covalent attachment to the surfactant X" or " "
  VARIANT (37)..(37): /replace="Ile" or "Aib" or "Ac4c" or "Ac5c" or "U; wherein 'U' is any natural or unnatural amino acid comprising a functional group used for covalent attachment to the surfactant X" or " "
  MOD_RES (38)..(38): U; wherein 'U' is any natural or unnatural amino acid comprising a functional group used for covalent attachment to the surfactant X
  VARIANT (38)..(38): /replace=" "
  source: /note="C-term OH, N-R4-His or -NH-R3"
  SITE (1)..(38): /note="Variant residues given in the sequence have no preference with respect to those in the annotations for variant positions"
  source: /note="See specification as filed for detailed description of substitutions and preferred embodiments"
XHSQGTFTSDYSKYLDSRRAQDFVAWLMNTKRNRNNAX

SEQ ID NO: 1109 - protein, 30 aa, Artificial Sequence
  source: /note="Description of Artificial Sequence: Synthetic polypeptide"
  MOD_RES (1)..(1): pGlu
  VARIANT (1)..(1): /replace=" "
  VARIANT (2)..(2): /replace="N(R3)His" or "N(Ac)His"
  VARIANT (3)..(3): /replace="Ala" or "Gly" or "MePro" or "Aib" or "Ac4c" or "Ac5c"
  VARIANT (4)..(4): /replace="Cit"
  VARIANT (5)..(5): /replace="D-Ala"
  VARIANT (6)..(6): /replace="Ser"
  VARIANT (7)..(7): /replace="Trp" or "2FPhe" or "MePhe" or "2FMePhe" or "Nal2"
  VARIANT (8)..(8): /replace="Ser"
  VARIANT (9)..(9): /replace="Asp"
  VARIANT (10)..(10): /replace="Glu"
  VARIANT (11)..(11): /replace="Leu" or "Met" or "Nal2" or "Bip" or "Bip2EtMeO" or "U(X); wherein 'U' is a natural or unnatural amino acid comprising a functional group covalently attached to the surfactant X" or " "
  VARIANT (12)..(12): /replace="Asn" or "Bip" or "U(X); wherein 'U' is a natural or unnatural amino acid comprising a functional group covalently attached to the surfactant X" or " "
  VARIANT (13)..(13): /replace="Glu" or "Ser" or "Arg" or "U(X); wherein 'U' is a natural or unnatural amino acid comprising a functional group covalently attached to the surfactant X" or " "
  VARIANT (14)..(14): /replace="Gln" or "Cit" or "U(X); wherein 'U' is a natural or unnatural amino acid comprising a functional group covalently attached to the surfactant X" or " "
  VARIANT (15)..(15): /replace="Met" or "Nle" or "Glu" or "Lys" or "U(X); wherein 'U' is a natural or unnatural amino acid comprising a functional group covalently attached to the surfactant X" or " "
  VARIANT (16)..(16): /replace="Glu" or "U(X); wherein 'U' is a natural or unnatural amino acid comprising a functional group covalently attached to the surfactant X" or " "
  VARIANT (17)..(17): /replace="Gly" or "Glu" or "Ala" or "Aib" or "Ac5c" or "Lys" or "Arg" or "U(X); wherein 'U' is a natural or unnatural amino acid comprising a functional group covalently attached to the surfactant X" or " "
  VARIANT (18)..(18): /replace="hArg" or "Gln" or "Glu" or "Lys" or "Cit" or "Aib" or "Ac4c" or "Ac5c" or "U(X); wherein 'U' is a natural or unnatural amino acid comprising a functional group covalently attached to the surfactant X" or " "
  VARIANT (19)..(19): /replace="hArg" or "Ala" or "Aib" or "Ac4c" or "Ac5c" or "U(X); wherein 'U' is a natural or unnatural amino acid comprising a functional group covalently attached to the surfactant X" or " "
  VARIANT (20)..(20): /replace="Val" or "Aib" or "Ac4c" or "Ac5c" or "U(X); wherein 'U' is a natural or unnatural amino acid comprising a functional group covalently attached to the surfactant X" or " "
  VARIANT (21)..(21): /replace="Lys" or "Arg" or "Cit" or "Glu" or "Aib" or "Ac4c" or "Ac5c" or "U(X); wherein 'U' is a natural or unnatural amino acid comprising a functional group covalently attached to the surfactant X" or " "
  VARIANT (22)..(22): /replace="Glu" or "Leu" or "Aib" or "Ac4c" or "Ac5c" or "U(X); wherein 'U' is a natural or unnatural amino acid comprising a functional group covalently attached to the surfactant X" or " "
  VARIANT (23)..(23): /replace="Trp" or "Nal2" or "Aib" or "Ac4c" or "Ac5c" or "U(X); wherein 'U' is a natural or unnatural amino acid comprising a functional group covalently attached to the surfactant X" or " "
  VARIANT (24)..(24): /replace="Ile" or "Aib" or "Ac4c" or "Ac5c" or "U(X); wherein 'U' is a natural or unnatural amino acid comprising a functional group covalently attached to the surfactant X" or " "
  VARIANT (25)..(25): /replace="Gln" or "Glu" or "Cit" or "U(X); wherein 'U' is a natural or unnatural amino acid comprising a functional group covalently attached to the surfactant X" or " "
  VARIANT (26)..(26): /replace="Nal2" or "U(X); wherein 'U' is a natural or unnatural amino acid comprising a functional group covalently attached to the surfactant X" or " "
  VARIANT (27)..(27): /replace="U(X); wherein 'U' is a natural or unnatural amino acid comprising a functional group covalently attached to the surfactant X" or " "
  VARIANT (28)..(28): /replace="Val" or "Leu" or "Nle" or "Lys" or "U(X); wherein 'U' is a natural or unnatural amino acid comprising a functional group covalently attached to the surfactant X" or " "
  VARIANT (29)..(29): /replace="Lys" or "Glu" or "Gln" or "U(X); wherein 'U' is a natural or unnatural amino acid comprising a functional group covalently attached to the surfactant X" or " "
  VARIANT (30)..(30): /replace="Gly" or "Aib" or "Ac4c" or "Ac5c" or "U(X); wherein 'U' is a natural or unnatural amino acid comprising a functional group covalently attached to the surfactant X" or " "
  source: /note="C-term -OH or -NH-R3"
  SITE (1)..(30): /note="Variant residues given in the sequence have no preference with respect to those in the annotations for variant positions"
  source: /note="See specification as filed for detailed description of substitutions and preferred embodiments"
XHSQGTFTSDYSKYLDSRRAQDFVAWLMNT

SEQ ID NO: 1110 - protein, 29 aa, Artificial Sequence
  source: /note="Description of Artificial Sequence: Synthetic peptide"
  MOD_RES (2)..(2): Aib
  VARIANT (10)..(10): /replace="Glu" or "Lys" or "U(X); wherein 'U' is any natural or unnatural amino acid comprising a functional group used for covalent attachment to the surfactant X"
  VARIANT (12)..(12): /replace="Glu"
  VARIANT (14)..(14): /replace="Glu" or "Lys"
  VARIANT (16)..(16): /replace="Lys"
  VARIANT (17)..(17): /replace="Glu" or "U(X); wherein 'U' is any natural or unnatural amino acid comprising a functional group used for covalent attachment to the surfactant X"
  VARIANT (20)..(20): /replace="Lys" or "U(X); wherein 'U' is any natural or unnatural amino acid comprising a functional group used for covalent attachment to the surfactant X"
  VARIANT (24)..(24): /replace="Glu" or "U(X); wherein 'U' is any natural or unnatural amino acid comprising a functional group used for covalent attachment to the surfactant X"
  VARIANT (28)..(28): /replace="Gln"
  source: /note="C-term -OH or -NH-R3"
  SITE (1)..(29): /note="Variant residues given in the sequence have no preference with respect to those in the annotations for variant positions"
  source: /note="See specification as filed for detailed description of substitutions and preferred embodiments"
HXQGTFTSDYSKYLDEQAAEEFIQWLLET

SEQ ID NO: 1111 - protein, 30 aa, Artificial Sequence
  source: /note="Description of Artificial Sequence: Synthetic polypeptide"
  VARIANT (2)..(2): /replace="MePro" or "Aib"
  VARIANT (3)..(3): /replace="Cit"
  VARIANT (6)..(6): /replace="2FPhe" or "MePhe" or "2FMePhe" or "Nal2"
  VARIANT (10)..(10): /replace="Nal2" or "Bip" or "Bip2EtMeO" or "Glu" or "Lys" or "U(X); wherein 'U' is any natural or unnatural amino acid comprising a functional group used for covalent attachment to the surfactant X"
  VARIANT (11)..(11): /replace="Asn" or "Bip" or "U(X); wherein 'U' is any natural or unnatural amino acid comprising a functional group used for covalent attachment to the surfactant X" or " "
  VARIANT (12)..(12): /replace="Glu" or "Ser" or "U(X); wherein 'U' is any natural or unnatural amino acid comprising a functional group used for covalent attachment to the surfactant X" or " "
  VARIANT (13)..(13): /replace="Gln" or "Cit" or "U(X); wherein 'U' is any natural or unnatural amino acid comprising a functional group used for covalent attachment to the surfactant X" or " "
  VARIANT (14)..(14): /replace="Nle" or "Glu" or "Lys" or "U(X); wherein 'U' is any natural or unnatural amino acid comprising a functional group used for covalent attachment to the surfactant X" or " "
  VARIANT (15)..(15): /replace="Glu" or "U(X); wherein 'U' is any natural or unnatural amino acid comprising a functional group used for covalent attachment to the surfactant X" or " "
  VARIANT (16)..(16): /replace="Gly" or "Glu" or "Ala" or "Aib" or "Lys" or "Arg" or "U(X); wherein 'U' is any natural or unnatural amino acid comprising a functional group used for covalent attachment to the surfactant X" or " "
  VARIANT (17)..(17): /replace="hArg" or "Gln" or "Glu" or "Lys" or "Cit" or "Aib" or "U(X); wherein 'U' is any natural or unnatural amino acid comprising a functional group used for covalent attachment to the surfactant X" or " "
  VARIANT (18)..(18): /replace="hArg" or "Ala" or "Aib" or "Ac4c" or "Ac5c" or "U(X); wherein 'U' is any natural or unnatural amino acid comprising a functional group used for covalent attachment to the surfactant X" or " "
  VARIANT (19)..(19): /replace="Aib" or "U(X); wherein 'U' is any natural or unnatural amino acid comprising a functional group used for covalent attachment to the surfactant X" or " "
  VARIANT (20)..(20): /replace="Lys" or "Arg" or "Cit" or "Glu" or "Aib" or "U(X); wherein 'U' is any natural or unnatural amino acid comprising a functional group used for covalent attachment to the surfactant X" or " "
  VARIANT (21)..(21): /replace="Glu" or "Leu" or "Aib" or "U(X); wherein 'U' is any natural or unnatural amino acid comprising a functional group used for covalent attachment to the surfactant X" or " "
  VARIANT (22)..(22): /replace="U(X); wherein 'U' is any natural or unnatural amino acid comprising a functional group used for covalent attachment to the surfactant X" or " "
  VARIANT (23)..(23): /replace="Ile" or "Aib" or "U(X); wherein 'U' is any natural or unnatural amino acid comprising a functional group used for covalent attachment to the surfactant X" or " "
  VARIANT (24)..(24): /replace="Glu" or "Gln" or "U(X); wherein 'U' is any natural or unnatural amino acid comprising a functional group used for covalent attachment to the surfactant X" or " "
  VARIANT (25)..(25): /replace="U(X); wherein 'U' is any natural or unnatural amino acid comprising a functional group used for covalent attachment to the surfactant X" or " "
  VARIANT (26)..(26): /replace="U(X); wherein 'U' is any natural or unnatural amino acid comprising a functional group used for covalent attachment to the surfactant X" or " "
  VARIANT (27)..(27): /replace="Val" or "Leu" or "Nle" or "Lys" or "U(X); wherein 'U' is any natural or unnatural amino acid comprising a functional group used for covalent attachment to the surfactant X" or " "
  VARIANT (28)..(28): /replace="Glu" or "Gln" or "Cit" or "U(X); wherein 'U' is any natural or unnatural amino acid comprising a functional group used for covalent attachment to the surfactant X" or " "
  VARIANT (29)..(29): /replace="Thr" or "Aib" or "U(X); wherein 'U' is any natural or unnatural amino acid comprising a functional group used for covalent attachment to the surfactant X" or " "
  VARIANT (30)..(30): /replace="Arg" or "U(X); wherein 'U' is any natural or unnatural amino acid comprising a functional group used for covalent attachment to the surfactant X" or " "
  source: /note="C-term OH or -NH-R3"
  SITE (1)..(30): /note="Variant residues given in the sequence have no preference with respect to those in the annotations for variant positions"
  source: /note="See specification as filed for detailed description of substitutions and preferred embodiments"
HGQGTFTSDYSKYLDSRRAQDFVAWLMNTR

SEQ ID NO: 1112 - skipped

SEQ ID NO: 1113 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(N-omega-X)
  source: /note="C-term -OH or -NHR3"
HXQGTFTSDYSKYLDEQAAKEFIXWLLQT

SEQ ID NO: 1114 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(N-omega(1-dodecyl alpha-D-melibiouronyl))
  SITE (20)..(20): /note="Lys cyclized through side chain to form a lactam linkage"
  MOD_RES (24)..(24): Lys(N-omega(1-dodecyl beta-D-glucouronyl))
  source: /note="C-term amide"
HXQGTFTSDYSKYLDEXAAKEFIXWLLQT

SEQ ID NO: 1115 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(N-omega(1-tetradecyl alpha-D-melibiouronyl))
  SITE (20)..(20): /note="Lys cyclized through side chain to form a lactam linkage"
  MOD_RES (24)..(24): Lys(N-omega(1-tetradecyl beta-D-glucouronyl))
  source: /note="C-term amide"
HXQGTFTSDYSKYLDEXAAKEFIXWLLQT

SEQ ID NO: 1116 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(N-omega(1-hexadecyl alpha-D-melibiouronyl))
  SITE (20)..(20): /note="Lys cyclized through side chain to form a lactam linkage"
  MOD_RES (24)..(24): Lys(N-omega(1-hexadecyl beta-D-glucouronyl))
  source: /note="C-term amide"
HXQGTFTSDYSKYLDEXAAKEFIXWLLQT

SEQ ID NO: 1117 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(N-omega(1-(13-carboxyl-tridecyloxy) beta-D-glucuronyl))
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1118 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(N-omega(1-(15-carboxyl-pentadecyloxy) beta-D-glucuronyl))
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1119 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  MOD_RES (17)..(17): Lys(N-omega(1-(17-carboxyl-heptadecyloxy) beta-D-glucuronyl))
  SITE (20)..(20): /note="Lys cyclized through side chain to form a lactam linkage"
  source: /note="C-term amide"
HXQGTFTSDYSKYLDEXAAKEFIQWLLQT

SEQ ID NO: 1120 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(N-omega(1-(13-carboxyl-tridecyloxy) beta-D-glucuronyl))
  source: /note="C-term amide"
HXQGTFTSDYSKYLDEQAAKEFIXWLLQT

SEQ ID NO: 1121 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(N-omega(1-(15-carboxyl-pentadecyloxy) beta-D-glucuronyl))
  source: /note="C-term amide"
HXQGTFTSDYSKYLDEQAAKEFIXWLLQT

SEQ ID NO: 1122 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(N-omega(1-(17-carboxyl-heptadecyloxy) beta-D-glucuronyl))
  source: /note="C-term amide"
HXQGTFTSDYSKYLDEQAAKEFIXWLLQT

SEQ ID NO: 1123 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(N-omega[1-(17-carboxyl-heptadecyloxy) beta-D-glucuronyl])
  source: /note="C-term amide"
HXQGTFTSDYSKYLDEQAAKEFIXWLLQT

SEQ ID NO: 1124 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(N-omega[1-(15-carboxyl-pentadecyloxy) beta-D-melibiouronyl])
  source: /note="C-term amide"
HXQGTFTSDYSKYLDEQAAKEFIXWLLQT

SEQ ID NO: 1125 - protein, 29 aa, Artificial Sequence
  source: /note="Description of Artificial Sequence: Synthetic peptide"
  MOD_RES (2)..(2): Aib
  SITE (16)..(20): /note="Cyclic"
  SITE (16)..(16): /note="Glu cyclized through side chain to form a lactam linkage"
  SITE (20)..(20): /note="Lys cyclized through side chain to form a lactam linkage"
  MOD_RES (24)..(24): Lys(N-omega[1-(17-carboxyl-heptadecyloxy) beta-D-melibiouronyl])
  source: /note="C-term amide"
HXQGTFTSDYSKYLDEQAAKEFIXWLLQT

SEQ ID NO: 1126 - protein, 29 aa, Artificial Sequence
  source: /note="Description of Artificial Sequence: Synthetic peptide"
  VARIANT (2)..(2): /replace="Aib"
  VARIANT (16)..(16): /replace="Ser" or "Ala" or "Lys" or "Aib"
  VARIANT (17)..(17): /replace="Lys" or "U(X); wherein 'U' is any natural or unnatural amino acid comprising a functional group used for covalent attachment to the surfactant X"
  VARIANT (20)..(20): /replace="Glu" or "Arg"
  VARIANT (23)..(23): /replace="Val"
  VARIANT (24)..(24): /replace="Gln" or "U(X); wherein 'U' is any natural or unnatural amino acid comprising a functional group used for covalent attachment to the surfactant X"
  VARIANT (27)..(27): /replace="Val" or "Leu"
  VARIANT (28)..(28): /replace="Gln" or "U(X); wherein 'U' is any natural or unnatural amino acid comprising a functional group used for covalent attachment to the surfactant X"
  source: /note="C-term amide"
  SITE (1)..(29): /note="Variant residues given in the sequence have no preference with respect to those in the annotations for variant positions"
HGQGTFTSDYSKYLDEQAAKEFIAWLMNT

SEQ ID NO: 1127 - protein, 29 aa, Artificial Sequence
  source: /note="Description of Artificial Sequence: Synthetic peptide"
  VARIANT (2)..(2): /replace="Aib"
  VARIANT (16)..(16): /replace="Ala" or "Aib"
  VARIANT (17)..(17): /replace="hArg" or "Gln"
  MOD_RES (20)..(20): U(X); wherein 'U' is any natural or unnatural amino acid comprising a functional group used for covalent attachment to the surfactant X
  VARIANT (23)..(23): /replace="Val"
  VARIANT (24)..(24): /replace="Ala"
  VARIANT (27)..(27): /replace="Val"
  VARIANT (28)..(28): /replace="Gln"
  source: /note="C-term amide"
  SITE (1)..(29): /note="Variant residues given in the sequence have no preference with respect to those in the annotations for variant positions"
HGQGTFTSDYSKYLDERRAXDFIQWLLNT

SEQ ID NO: 1128 - protein, 11 aa, Artificial Sequence
  source: /note="Description of Artificial Sequence: Synthetic peptide"
  MOD_RES (2)..(2): Aib
  MOD_RES (6)..(6): Alpha-MeF
  MOD_RES (10)..(10): Bip
  MOD_RES (11)..(11): Lys(C20)
  source: /note="C-term amide"
HXQGTXTSDXX

SEQ ID NO: 1129 - protein, 11 aa, Artificial Sequence
  source: /note="Description of Artificial Sequence: Synthetic peptide"
  MOD_RES (2)..(2): Aib
  MOD_RES (6)..(6): alpha-MeFF
  MOD_RES (10)..(10): Bip
  MOD_RES (11)..(11): Lys(C8)
  source: /note="C-term amide"
HXQGTXTSDXX

SEQ ID NO: 1130 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): Lys(C12)
  source: /note="C-term amide"
HXQGTXTSDXX

SEQ ID NO: 1131 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): Lys(C14)
  source: /note="C-term amide"
HXQGTXTSDXX

SEQ ID NO: 1132 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): Lys(C16)
  source: /note="C-term amide"
HXQGTXTSDXX

SEQ ID NO: 1133 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): Lys(C18)
  source: /note="C-term amide"
HXQGTXTSDXX

SEQ ID NO: 1134 - protein, 11 aa, Artificial Sequence
  source: /note="Description of Artificial Sequence: Synthetic peptide"
  MOD_RES (2)..(2): Aib
  MOD_RES (6)..(6): Alpha-MeFF
  MOD_RES (10)..(10): Bip
  MOD_RES (11)..(11): Lys(C20)
  source: /note="C-term amide"
HXQGTXTSDXX

SEQ ID NO: 1135 - protein, 29 aa, Artificial Sequence
  source: /note="Description of Artificial Sequence: Synthetic peptide"
  MOD_RES (17)..(17): Lys(C8)
  source: /note="C-term amide"
HGQGTFTSDYSKYLDAXAAREFIAWLLNT

SEQ ID NO: 1136 - protein, 29 aa, Artificial Sequence
  source: /note="Description of Artificial Sequence: Synthetic peptide"
  MOD_RES (17)..(17): Lys(C12)
  source: /note="C-term amide"
HGQGTFTSDYSKYLDAXAAREFIAWLLNT

SEQ ID NO: 1137 - protein, 29 aa, Artificial Sequence
  source: /note="Description of Artificial Sequence: Synthetic peptide"
  MOD_RES (17)..(17): Lys(C14)
  source: /note="C-term amide"
HGQGTFTSDYSKYLDAXAAREFIAWLLNT

What is claimed is:

1. A method of treating a fatty liver disease, comprising administering a peptide product, or a pharmaceutically acceptable salt thereof, to a subject in need thereof, wherein the peptide product comprises:

(SEQ. ID. NO. 1119)
a) $His_1$-$Aib_2$-$Gln_3$-$Gly_4$-$Thr_5$-$Phe_6$-$Thr_7$-$Ser_8$-$Asp_9$-$Tyr_{10}$-$Ser_{11}$-$Lys_{12}$-$Tyr_{13}$-$Leu_{14}$-$Asp_{15}$-$Glu*_{16}$-Lys(N-omega[1-(17-carboxyl-heptadecyloxy)beta-D-glucuronyl])$_{17}$-$Ala_{18}$-$Ala_{19}$-$Lys*_{20}$-$Glu_{21}$-$Phe_{22}$-$Ile_{23}$-$Gln_{24}$-$Trp_{25}$-$Leu_{26}$-$Leu_{27}$-$Gln_{28}$-$Thr_{29}$-$Nh_2$, wherein $Glu_{16}*$ and $Lys_{20}*$ denote residues that are cyclized through their side chains to form a lactam linkage; and, b) a pharmaceutically acceptable diluent or buffer; and wherein the fatty liver disease is non-alcoholic fatty liver disease (NAFLD) or non-alcoholic steatohepatitis (NASH).

2. The method of claim 1, wherein the treating comprises administering the peptide product by subcutaneous, intravenous or intramuscular injection.

3. The method of claim 1, wherein the treating comprises administering the peptide product about once a week.

4. The method of claim 1, wherein the treating comprises administration of the peptide product by oral inhalation or nasal inhalation or insufflation.

5. The method of claim 2, wherein the administration of the peptide product is in a dose from 0.1 mg to 10 mg, over a period of about one week.

6. The method of claim 2, wherein the administration of the peptide product is in a dose of about 0.1 to 1 mg, over a period of about one week.

\* \* \* \* \*